United States Patent 7,300,788 (METHOD FOR GENOTYPING POLYMORPHISMS IN HUMANS) - sequence listing, part 4

SEQ ID NO: 119962 - DNA, 25 bp, Homo sapien
tttagttgtagttagaggcatccca

SEQ ID NO: 119963 - DNA, 25 bp, Homo sapien
tttagttgtagttataggcatccca

SEQ ID NO: 119964 - DNA, 25 bp, Homo sapien
tttagtttgcaccattgttcctgtt

SEQ ID NO: 119965 - DNA, 25 bp, Homo sapien
tttagtttgcaccgttgttcctgtt

SEQ ID NO: 119966 - DNA, 25 bp, Homo sapien
tttataaagcactaacaataggcca

SEQ ID NO: 119967 - DNA, 25 bp, Homo sapien
tttataaagcactaacgataggcca

SEQ ID NO: 119968 - DNA, 25 bp, Homo sapien
tttataaatccattcactacccatc

SEQ ID NO: 119969 - DNA, 25 bp, Homo sapien
tttataaatccgttcactacccatc

SEQ ID NO: 119970 - DNA, 25 bp, Homo sapien
tttataactaacttactgacaatta

SEQ ID NO: 119971 - DNA, 25 bp, Homo sapien
tttataactaatttactgacaatta

SEQ ID NO: 119972 - DNA, 25 bp, Homo sapien
tttataactcgtaatgaatgttaag

SEQ ID NO: 119973 - DNA, 25 bp, Homo sapien
tttataacttgtaatgaatgttaag

SEQ ID NO: 119974 - DNA, 25 bp, Homo sapien
tttataagacacctagtttatggta

SEQ ID NO: 119975 - DNA, 25 bp, Homo sapien
tttataagccatataattttgcaag

SEQ ID NO: 119976 - DNA, 25 bp, Homo sapien
tttataaggcacctagtttatggta

SEQ ID NO: 119977 - DNA, 25 bp, Homo sapien
tttataagtcatataattttgcaag

SEQ ID NO: 119978 - DNA, 25 bp, Homo sapien
tttataatccttcctcaactagttc

SEQ ID NO: 119979 - DNA, 25 bp, Homo sapien
tttataatcctttctcaactagttc

SEQ ID NO: 119980 - DNA, 25 bp, Homo sapien
tttatacaagtgtgttctttcagct

SEQ ID NO: 119981 - DNA, 25 bp, Homo sapien
tttatacaagtgtgttttttcagct

SEQ ID NO: 119982 - DNA, 25 bp, Homo sapien
tttatacagcttgggtatggctatg

SEQ ID NO: 119983 - DNA, 25 bp, Homo sapien
tttatacagcttggttatggctatg

SEQ ID NO: 119984 - DNA, 25 bp, Homo sapien
tttatacctactgacctggcgtctc

SEQ ID NO: 119985 - DNA, 25 bp, Homo sapien
tttatacctactgccctggcgtctc

SEQ ID NO: 119986 - DNA, 25 bp, Homo sapien
tttatacgatgaaaacgatatgata

SEQ ID NO: 119987 - DNA, 25 bp, Homo sapien
tttatacgatgaaaactatatgata

SEQ ID NO: 119988 - DNA, 25 bp, Homo sapien
tttatactcttgcggttttgtgaat

SEQ ID NO: 119989 - DNA, 25 bp, Homo sapien
tttatactcttgtggttttgtgaat

SEQ ID NO: 119990 - DNA, 25 bp, Homo sapien
tttatagaccattgaaagatccctg

SEQ ID NO: 119991 - DNA, 25 bp, Homo sapien
tttatagaccatttaaagatccctg

SEQ ID NO: 119992 - DNA, 25 bp, Homo sapien
tttatagagaaaacactgtattggt

SEQ ID NO: 119993 - DNA, 25 bp, Homo sapien
tttatagagaaaacgctgtattggt

SEQ ID NO: 119994 - DNA, 25 bp, Homo sapien
tttatagagcacatccacagtatac

SEQ ID NO: 119995 - DNA, 25 bp, Homo sapien
tttatagagtacatccacagtatac

SEQ ID NO: 119996 - DNA, 25 bp, Homo sapien
tttatagatttggaatcctgttatg

SEQ ID NO: 119997 - DNA, 25 bp, Homo sapien
tttatagatttggagtcctgttatg

SEQ ID NO: 119998 - DNA, 25 bp, Homo sapien
tttatagcaacaataatagaatgat

SEQ ID NO: 119999 - DNA, 25 bp, Homo sapien
tttatagcaaccataatagaatgat

SEQ ID NO: 120000 - DNA, 25 bp, Homo sapien
tttatagcagcattttaaaaagtag

SEQ ID NO: 120001 - DNA, 25 bp, Homo sapien
tttatagcagcgttttaaaaagtag

SEQ ID NO: 120002 - DNA, 25 bp, Homo sapien
tttatagccgtattacttcaaattg

SEQ ID NO: 120003 - DNA, 25 bp, Homo sapien
tttatagctgtattacttcaaattg

SEQ ID NO: 120004 - DNA, 25 bp, Homo sapien
tttatagcttggcggtatgtttgta

SEQ ID NO: 120005 - DNA, 25 bp, Homo sapien
tttatagcttggtggtatgtttgta

SEQ ID NO: 120006 - DNA, 25 bp, Homo sapien
tttataggccttcagtgtcagcaaa

SEQ ID NO: 120007 - DNA, 25 bp, Homo sapien
tttatagggcttcagtgtcagcaaa

SEQ ID NO: 120008 - DNA, 25 bp, Homo sapien
tttataggttcttactttattgcac

SEQ ID NO: 120009 - DNA, 25 bp, Homo sapien
tttataggttcttattttattgcac

SEQ ID NO: 120010 - DNA, 25 bp, Homo sapien
tttatagtcctgcaattatcagcag

SEQ ID NO: 120011 - DNA, 25 bp, Homo sapien
tttatagtcttgcaattatcagcag

SEQ ID NO: 120012 - DNA, 25 bp, Homo sapien
tttatagttgtcatcagtagggaac

SEQ ID NO: 120013 - DNA, 25 bp, Homo sapien
tttatagttgtcgtcagtagggaac

SEQ ID NO: 120014 - DNA, 25 bp, Homo sapien
tttatagtttcgcctactcttcttt

SEQ ID NO: 120015 - DNA, 25 bp, Homo sapien
tttatagtttcgtctactcttcttt

SEQ ID NO: 120016 - DNA, 25 bp, Homo sapien
tttatagttttaatgtttaatgagc

SEQ ID NO: 120017 - DNA, 25 bp, Homo sapien
tttatagttttaatttttaatgagc

SEQ ID NO: 120018 - DNA, 25 bp, Homo sapien
tttatataaatgagaacacactgag

SEQ ID NO: 120019 - DNA, 25 bp, Homo sapien
tttatataaatgcgaacacactgag

SEQ ID NO: 120020 - DNA, 25 bp, Homo sapien
tttatataaggaaattgaacatctg

SEQ ID NO: 120021 - DNA, 25 bp, Homo sapien
tttatataaggaacttgaacatctg

SEQ ID NO: 120022 - DNA, 25 bp, Homo sapien
tttatatagtcaatatccgtgtaga

SEQ ID NO: 120023 - DNA, 25 bp, Homo sapien
tttatatagtcgatatccgtgtaga

SEQ ID NO: 120024 - DNA, 25 bp, Homo sapien
tttatatatttctcacttacctttc

SEQ ID NO: 120025 - DNA, 25 bp, Homo sapien
tttatatatttgtcacttacctttc

SEQ ID NO: 120026 - DNA, 25 bp, Homo sapien
tttatatcaccaaagcaccaatgtt

SEQ ID NO: 120027 - DNA, 25 bp, Homo sapien
tttatatcaggtctcttcacaaacg

SEQ ID NO: 120028 - DNA, 25 bp, Homo sapien
tttatatccaaacaagtcaagctag

SEQ ID NO: 120029 - DNA, 25 bp, Homo sapien
tttatatccaagcaagtcaagctag

SEQ ID NO: 120030 - DNA, 25 bp, Homo sapien
tttatatcgccaaagcaccaatgtt

SEQ ID NO: 120031 - DNA, 25 bp, Homo sapien
tttatatctggtctcttcacaaacg

SEQ ID NO: 120032 - DNA, 25 bp, Homo sapien
tttatatgacacgagaaaaaatggt

SEQ ID NO: 120033 - DNA, 25 bp, Homo sapien
tttatatgacatgagaaaaaatggt

SEQ ID NO: 120034 - DNA, 25 bp, Homo sapien
tttatattagacacaagtacttagg

SEQ ID NO: 120035 - DNA, 25 bp, Homo sapien
tttatattagacgcaagtacttagg

SEQ ID NO: 120036 - DNA, 25 bp, Homo sapien
tttatcaaaattccaaaatataaag

SEQ ID NO: 120037 - DNA, 25 bp, Homo sapien
tttatcaaaattccgaaatataaag

SEQ ID NO: 120038 - DNA, 25 bp, Homo sapien
tttatcaaatatgattagaaaacaa

SEQ ID NO: 120039 - DNA, 25 bp, Homo sapien
tttatcaaatatgattggaaaacaa

SEQ ID NO: 120040 - DNA, 25 bp, Homo sapien
tttatcaagggccatttctgtgtaa

SEQ ID NO: 120041 - DNA, 25 bp, Homo sapien
tttatcaagggctatttctgtgtaa

SEQ ID NO: 120042 - DNA, 25 bp, Homo sapien
tttatcaatcacctgcaatgccctg

SEQ ID NO: 120043 - DNA, 25 bp, Homo sapien
tttatcaatgaagtttatgtaatat

SEQ ID NO: 120044 - DNA, 25 bp, Homo sapien
tttatcaatgaattttatgtaatat

SEQ ID NO: 120045 - DNA, 25 bp, Homo sapien
tttatcaattacctgcaatgccctg

SEQ ID NO: 120046 - DNA, 25 bp, Homo sapien
tttatcaccgctcctccttgtactt

SEQ ID NO: 120047 - DNA, 25 bp, Homo sapien
tttatcactcaagactattgtgtca

SEQ ID NO: 120048 - DNA, 25 bp, Homo sapien
tttatcactcaggactattgtgtca

SEQ ID NO: 120049 - DNA, 25 bp, Homo sapien
tttatcactgctcctccttgtactt

SEQ ID NO: 120050 - DNA, 25 bp, Homo sapien
tttatcagtccatgagtaatactgc

SEQ ID NO: 120051 - DNA, 25 bp, Homo sapien
tttatcagtccgtgagtaatactgc

SEQ ID NO: 120052 - DNA, 25 bp, Homo sapien
tttatcatgcgtgacccctgaagtc

SEQ ID NO: 120053 - DNA, 25 bp, Homo sapien
tttatcatgcgtgatccctgaagtc

SEQ ID NO: 120054 - DNA, 25 bp, Homo sapien
tttatcatgctcccattgtgaactt

SEQ ID NO: 120055 - DNA, 25 bp, Homo sapien
tttatcatgctcccgttgtgaactt

SEQ ID NO: 120056 - DNA, 25 bp, Homo sapien
tttatcattcacctaaagacccact

SEQ ID NO: 120057 - DNA, 25 bp, Homo sapien
tttatcattcatctaaagacccact

SEQ ID NO: 120058 - DNA, 25 bp, Homo sapien
tttatcattttcttacatggctata

SEQ ID NO: 120059 - DNA, 25 bp, Homo sapien
tttatcatttttttacatggctata

SEQ ID NO: 120060 - DNA, 25 bp, Homo sapien
tttatccagaggcgtggacttagta

SEQ ID NO: 120061 - DNA, 25 bp, Homo sapien
tttatccagaggtgtggacttagta

SEQ ID NO: 120062 - DNA, 25 bp, Homo sapien
tttatcccaagtcctctgactcgtc

SEQ ID NO: 120063 - DNA, 25 bp, Homo sapien
tttatcccaagtcttctgactcgtc

SEQ ID NO: 120064 - DNA, 25 bp, Homo sapien
tttatcgtggtataacaggcactgc

SEQ ID NO: 120065 - DNA, 25 bp, Homo sapien
tttatcgtggtgtaacaggcactgc

SEQ ID NO: 120066 - DNA, 25 bp, Homo sapien
tttatcgttttcagaacatctctgt

SEQ ID NO: 120067 - DNA, 25 bp, Homo sapien
tttatcgttttcggaacatctctgt

SEQ ID NO: 120068 - DNA, 25 bp, Homo sapien
tttatctccaatgtcacttttaaca

SEQ ID NO: 120069 - DNA, 25 bp, Homo sapien
tttatctcccatgtcacttttaaca

SEQ ID NO: 120070 - DNA, 25 bp, Homo sapien
tttatctcttgcgagtacgatttca

SEQ ID NO: 120071 - DNA, 25 bp, Homo sapien
tttatctcttgggagtacgatttca

SEQ ID NO: 120072 - DNA, 25 bp, Homo sapien
tttatctgaaactagagttcgtatg

SEQ ID NO: 120073 - DNA, 25 bp, Homo sapien
tttatctgaaattagagttcgtatg

SEQ ID NO: 120074 - DNA, 25 bp, Homo sapien
tttatctgttctgtccctacagtga

SEQ ID NO: 120075 - DNA, 25 bp, Homo sapien
tttatctgttctgttcctacagtga

SEQ ID NO: 120076 - DNA, 25 bp, Homo sapien
tttatcttattgctccagcactcgg

SEQ ID NO: 120077 - DNA, 25 bp, Homo sapien
tttatcttattgttccagcactcgg

SEQ ID NO: 120078 - DNA, 25 bp, Homo sapien
tttatcttgcatgaacttttgtaac

SEQ ID NO: 120079 - DNA, 25 bp, Homo sapien
tttatcttgcatggacttttgtaac

SEQ ID NO: 120080 - DNA, 25 bp, Homo sapien
tttatcttgctgagttctagtcgca

SEQ ID NO: 120081 - DNA, 25 bp, Homo sapien
tttatcttgcttagttctagtcgca

SEQ ID NO: 120082 - DNA, 25 bp, Homo sapien
tttatcttggctttgtatacttcca

SEQ ID NO: 120083 - DNA, 25 bp, Homo sapien
tttatcttggctttgtgtacttcca

SEQ ID NO: 120084 - DNA, 25 bp, Homo sapien
tttatctttctacgcctctgtttgc

SEQ ID NO: 120085 - DNA, 25 bp, Homo sapien
tttatctttctatgcctctgtttgc

SEQ ID NO: 120086 - DNA, 25 bp, Homo sapien
tttatgaatcttactttaatttctc

SEQ ID NO: 120087 - DNA, 25 bp, Homo sapien
tttatgaatctttctttaatttctc

SEQ ID NO: 120088 - DNA, 25 bp, Homo sapien
tttatgaccttgagattgccagtga

SEQ ID NO: 120089 - DNA, 25 bp, Homo sapien
tttatgaccttgcgattgccagtga

SEQ ID NO: 120090 - DNA, 25 bp, Homo sapien
tttatgactctcacgtacacaccta

SEQ ID NO: 120091 - DNA, 25 bp, Homo sapien
tttatgactctcatgtacacaccta

SEQ ID NO: 120092 - DNA, 25 bp, Homo sapien
tttatgagaagagataatagggagc

SEQ ID NO: 120093 - DNA, 25 bp, Homo sapien
tttatgagcgcatgatatctgctag

SEQ ID NO: 120094 - DNA, 25 bp, Homo sapien
tttatgaggagagataatagggagc

SEQ ID NO: 120095 - DNA, 25 bp, Homo sapien
tttatgaggggctcttccaccttcg

SEQ ID NO: 120096 - DNA, 25 bp, Homo sapien
tttatgaggggcttttccaccttcg

SEQ ID NO: 120097 - DNA, 25 bp, Homo sapien
tttatgagtgcatgatatctgctag

SEQ ID NO: 120098 - DNA, 25 bp, Homo sapien
tttatgcatccttaactcaacatta

SEQ ID NO: 120099 - DNA, 25 bp, Homo sapien
tttatgcatccttagctcaacatta

SEQ ID NO: 120100 - DNA, 25 bp, Homo sapien
tttatgcatctgtcatctcttgctt

SEQ ID NO: 120101 - DNA, 25 bp, Homo sapien
tttatgcatctttcatctcttgctt

SEQ ID NO: 120102 - DNA, 25 bp, Homo sapien
tttatgcatgaaaacaccttcacaa

SEQ ID NO: 120103 - DNA, 25 bp, Homo sapien
tttatgcatgaaaataccttcacaa

SEQ ID NO: 120104 - DNA, 25 bp, Homo sapien
tttatgccaatgtgtgcccaacgtt

SEQ ID NO: 120105 - DNA, 25 bp, Homo sapien
tttatgccagtgtgtgcccaacgtt

SEQ ID NO: 120106 - DNA, 25 bp, Homo sapien
tttatgctactcattcctacacctc

SEQ ID NO: 120107 - DNA, 25 bp, Homo sapien
tttatgcttctcattcctacacctc

SEQ ID NO: 120108 - DNA, 25 bp, Homo sapien
tttatgcttttgatccttcccatat

SEQ ID NO: 120109 - DNA, 25 bp, Homo sapien
tttatgcttttggtccttcccatat

SEQ ID NO: 120110 - DNA, 25 bp, Homo sapien
tttatggaaaccatgacatacacta

SEQ ID NO: 120111 - DNA, 25 bp, Homo sapien
tttatggaaaccgtgacatacacta

SEQ ID NO: 120112 - DNA, 25 bp, Homo sapien
tttatggacaaccttgataagaccc

SEQ ID NO: 120113 - DNA, 25 bp, Homo sapien
tttatggacaaccttggtaagaccc

SEQ ID NO: 120114 - DNA, 25 bp, Homo sapien
tttatggagacctggctaaggagca

SEQ ID NO: 120115 - DNA, 25 bp, Homo sapien
tttatggagccctggctaaggagca

SEQ ID NO: 120116 - DNA, 25 bp, Homo sapien
tttatggcagagtgcgtgatggagg

SEQ ID NO: 120117 - DNA, 25 bp, Homo sapien
tttatggcagagtgtgtgatggagg

SEQ ID NO: 120118 - DNA, 25 bp, Homo sapien
tttatggccaatttgctacagcagt

SEQ ID NO: 120119 - DNA, 25 bp, Homo sapien
tttatggcctatttgctacagcagt

SEQ ID NO: 120120 - DNA, 25 bp, Homo sapien
tttatggctgtacgctgaaatgatc

SEQ ID NO: 120121 - DNA, 25 bp, Homo sapien
tttatggctgtatgctgaaatgatc

SEQ ID NO: 120122 - DNA, 25 bp, Homo sapien
tttatgggtcatctgccttttctct

SEQ ID NO: 120123 - DNA, 25 bp, Homo sapien
tttatgggtcatctgcgttttctct

SEQ ID NO: 120124 - DNA, 25 bp, Homo sapien
tttatggtaagatacagagaattta

SEQ ID NO: 120125 - DNA, 25 bp, Homo sapien
tttatggtaagatagagagaattta

SEQ ID NO: 120126 - DNA, 25 bp, Homo sapien
tttatggtaccagagaatttgtgat

SEQ ID NO: 120127 - DNA, 25 bp, Homo sapien
tttatggtatcagagaatttgtgat

SEQ ID NO: 120128 - DNA, 25 bp, Homo sapien
tttatggttaagcatgtggtcaatt

SEQ ID NO: 120129 - DNA, 25 bp, Homo sapien
tttatggttaagtatgtggtcaatt

SEQ ID NO: 120130 - DNA, 25 bp, Homo sapien
tttatggttcgatacatttcagtaa

SEQ ID NO: 120131 - DNA, 25 bp, Homo sapien
tttatggttgaattcccggaaatat

SEQ ID NO: 120132 - DNA, 25 bp, Homo sapien
tttatggttgaattcctggaaatat

SEQ ID NO: 120133 - DNA, 25 bp, Homo sapien
tttatggtttgatacatttcagtaa

SEQ ID NO: 120134 - DNA, 25 bp, Homo sapien
tttatgtcaaagattagatcaagca

SEQ ID NO: 120135 - DNA, 25 bp, Homo sapien
tttatgtcaaaggttagatcaagca

SEQ ID NO: 120136 - DNA, 25 bp, Homo sapien
tttatgtcctgccgattgagtatat

SEQ ID NO: 120137 - DNA, 25 bp, Homo sapien
tttatgtcctgctgattgagtatat

SEQ ID NO: 120138 - DNA, 25 bp, Homo sapien
tttatgtccttttctctgaatgtat

SEQ ID NO: 120139 - DNA, 25 bp, Homo sapien
tttatgtctttttctctgaatgtat

SEQ ID NO: 120140 - DNA, 25 bp, Homo sapien
tttatgtgcgaggtatttaggtttg

SEQ ID NO: 120141 - DNA, 25 bp, Homo sapien
tttatgtgctgtaggtatatctgta

SEQ ID NO: 120142 - DNA, 25 bp, Homo sapien
tttatgtgctgtatgtatatctgta

SEQ ID NO: 120143 - DNA, 25 bp, Homo sapien
tttatgtgtgaggtatttaggtttg

SEQ ID NO: 120144 - DNA, 25 bp, Homo sapien
tttatgttagaccattctggcagca

SEQ ID NO: 120145 - DNA, 25 bp, Homo sapien
tttatgttagaccgttctggcagca

SEQ ID NO: 120146 - DNA, 25 bp, Homo sapien
tttatgttccgacccaaaggacaaa

SEQ ID NO: 120147 - DNA, 25 bp, Homo sapien
tttatgttcctattgcctgtctccc

SEQ ID NO: 120148 - DNA, 25 bp, Homo sapien
tttatgttctgacccaaaggacaaa

SEQ ID NO: 120149 - DNA, 25 bp, Homo sapien
tttatgtttctattgcctgtctccc

SEQ ID NO: 120150 - DNA, 25 bp, Homo sapien
tttattaactacatgcgcttggaca

SEQ ID NO: 120151 - DNA, 25 bp, Homo sapien
tttattaactacgtgcgcttggaca

SEQ ID NO: 120152 - DNA, 25 bp, Homo sapien
tttattaagatgtaaggattcagga

SEQ ID NO: 120153 - DNA, 25 bp, Homo sapien
tttattaagttgtaaggattcagga

SEQ ID NO: 120154 - DNA, 25 bp, Homo sapien
tttattaatgtttcttcctgaatat

SEQ ID NO: 120155 - DNA, 25 bp, Homo sapien
tttattaatgtttcttgctgaatat

SEQ ID NO: 120156 - DNA, 25 bp, Homo sapien
tttattacacgtcacaaaaagtgtt

SEQ ID NO: 120157 - DNA, 25 bp, Homo sapien
tttattacataccaactcaagagtg

SEQ ID NO: 120158 - DNA, 25 bp, Homo sapien
tttattacatgtcacaaaaagtgtt

SEQ ID NO: 120159 - DNA, 25 bp, Homo sapien
tttattaccacaaacctccagtggg

SEQ ID NO: 120160 - DNA, 25 bp, Homo sapien
tttattaccattctgtagcagaacc

SEQ ID NO: 120161 - DNA, 25 bp, Homo sapien
tttattaccattttgtagcagaacc

SEQ ID NO: 120162 - DNA, 25 bp, Homo sapien
tttattaccgcaaacctccagtggg

SEQ ID NO: 120163 - DNA, 25 bp, Homo sapien
tttattacctaccaactcaagagtg

SEQ ID NO: 120164 - DNA, 25 bp, Homo sapien
tttattagaatatagccaaacatga

SEQ ID NO: 120165 - DNA, 25 bp, Homo sapien
tttattagaatatggccaaacatga

SEQ ID NO: 120166 - DNA, 25 bp, Homo sapien
tttattagaggtctagcagaaagtg

SEQ ID NO: 120167 - DNA, 25 bp, Homo sapien
tttattagaggtttagcagaaagtg

SEQ ID NO: 120168 - DNA, 25 bp, Homo sapien
tttattaggccagaggatcaaggtt

SEQ ID NO: 120169 - DNA, 25 bp, Homo sapien
tttattaggtcagaggatcaaggtt

SEQ ID NO: 120170 - DNA, 25 bp, Homo sapien
tttattataagccataggtacagaa

SEQ ID NO: 120171 - DNA, 25 bp, Homo sapien
tttattataagtcataggtacagaa

SEQ ID NO: 120172 - DNA, 25 bp, Homo sapien
tttattatcaacaatgataccactc

SEQ ID NO: 120173 - DNA, 25 bp, Homo sapien
tttattatcaactatgataccactc

SEQ ID NO: 120174 - DNA, 25 bp, Homo sapien
tttattatgtgatttttcctgctta

SEQ ID NO: 120175 - DNA, 25 bp, Homo sapien
tttattatgtggtttttcctgctta

SEQ ID NO: 120176 - DNA, 25 bp, Homo sapien
tttattcaacgggttcacaagtttt

SEQ ID NO: 120177 - DNA, 25 bp, Homo sapien
tttattcaacgtgttcacaagtttt

SEQ ID NO: 120178 - DNA, 25 bp, Homo sapien
tttattcacaatgtgagactcgctt

SEQ ID NO: 120179 - DNA, 25 bp, Homo sapien
tttattcacaatttgagactcgctt

SEQ ID NO: 120180 - DNA, 25 bp, Homo sapien
tttattcacatgtaatctcgtaatt

SEQ ID NO: 120181 - DNA, 25 bp, Homo sapien
tttattcacgtgtaatctcgtaatt

SEQ ID NO: 120182 - DNA, 25 bp, Homo sapien
tttattcagatgatcctacatatga

SEQ ID NO: 120183 - DNA, 25 bp, Homo sapien
tttattcagattatcctacatatga

SEQ ID NO: 120184 - DNA, 25 bp, Homo sapien
tttattcataaccacccaaacttgg

SEQ ID NO: 120185 - DNA, 25 bp, Homo sapien
tttattcataaccatccaaacttgg

SEQ ID NO: 120186 - DNA, 25 bp, Homo sapien
tttattccaatgttacaatctctaa

SEQ ID NO: 120187 - DNA, 25 bp, Homo sapien
tttattccaatgttgcaatctctaa

SEQ ID NO: 120188 - DNA, 25 bp, Homo sapien
tttattccatattaaaacatttccc

SEQ ID NO: 120189 - DNA, 25 bp, Homo sapien
tttattccatcaacacagtattgac

SEQ ID NO: 120190 - DNA, 25 bp, Homo sapien
tttattccatcgacacagtattgac

SEQ ID NO: 120191 - DNA, 25 bp, Homo sapien
tttattcccaattgcactggacaat

SEQ ID NO: 120192 - DNA, 25 bp, Homo sapien
tttattccgtattaaaacatttccc

SEQ ID NO: 120193 - DNA, 25 bp, Homo sapien
tttattcctaattgcactggacaat

SEQ ID NO: 120194 - DNA, 25 bp, Homo sapien
tttattcgctgcttcatctcccctg

SEQ ID NO: 120195 - DNA, 25 bp, Homo sapien
tttattcgctgtttcatctcccctg

SEQ ID NO: 120196 - DNA, 25 bp, Homo sapien
tttattctagtcatgattgcagctg

SEQ ID NO: 120197 - DNA, 25 bp, Homo sapien
tttattctagtcgtgattgcagctg

SEQ ID NO: 120198 - DNA, 25 bp, Homo sapien
tttattctccaaacaaatctatcgt

SEQ ID NO: 120199 - DNA, 25 bp, Homo sapien
tttattctccatacaaatctatcgt

SEQ ID NO: 120200 - DNA, 25 bp, Homo sapien
tttattctgcttaatgggtcgcttg

SEQ ID NO: 120201 - DNA, 25 bp, Homo sapien
tttattctgtttaatgggtcgcttg

SEQ ID NO: 120202 - DNA, 25 bp, Homo sapien
tttattcttctctggttgatgagat

SEQ ID NO: 120203 - DNA, 25 bp, Homo sapien
tttattcttctttggttgatgagat

SEQ ID NO: 120204 - DNA, 25 bp, Homo sapien
tttattgacatatactccttctcta

SEQ ID NO: 120205 - DNA, 25 bp, Homo sapien
tttattgacatctactccttctcta

SEQ ID NO: 120206 - DNA, 25 bp, Homo sapien
tttattgacgtaccagatggtgtga

SEQ ID NO: 120207 - DNA, 25 bp, Homo sapien
tttattgactaaatgacagaacata

SEQ ID NO: 120208 - DNA, 25 bp, Homo sapien
tttattgactaaatgagagaacata

SEQ ID NO: 120209 - DNA, 25 bp, Homo sapien
tttattgagaagagttaggaaataa

SEQ ID NO: 120210 - DNA, 25 bp, Homo sapien
tttattgagaagagtttggaaataa

SEQ ID NO: 120211 - DNA, 25 bp, Homo sapien
tttattgaggtaccagatggtgtga

SEQ ID NO: 120212 - DNA, 25 bp, Homo sapien
tttattgcaatgaatcttctcattc

SEQ ID NO: 120213 - DNA, 25 bp, Homo sapien
tttattgcaattaatcttctcattc

SEQ ID NO: 120214 - DNA, 25 bp, Homo sapien
tttattgctagactcgctttgctaa

SEQ ID NO: 120215 - DNA, 25 bp, Homo sapien
tttattgctagactcgttttgctaa

SEQ ID NO: 120216 - DNA, 25 bp, Homo sapien
tttattggaaaggaaagaaaagaac

SEQ ID NO: 120217 - DNA, 25 bp, Homo sapien
tttattggaaatgtagtccttgtcc

SEQ ID NO: 120218 - DNA, 25 bp, Homo sapien
tttattggagaggaaagaaaagaac

SEQ ID NO: 120219 - DNA, 25 bp, Homo sapien
tttattggagatgtagtccttgtcc

SEQ ID NO: 120220 - DNA, 25 bp, Homo sapien
tttattgtattgcaatttcctggct

SEQ ID NO: 120221 - DNA, 25 bp, Homo sapien
tttattgtattgccatttcctggct

SEQ ID NO: 120222 - DNA, 25 bp, Homo sapien
tttattgtctcttcccatacctctt

SEQ ID NO: 120223 - DNA, 25 bp, Homo sapien
tttattgtctcttctcatacctctt

SEQ ID NO: 120224 - DNA, 25 bp, Homo sapien
tttattgtctgtacaacccagcaca

SEQ ID NO: 120225 - DNA, 25 bp, Homo sapien
tttattgtctgtaccacccagcaca

SEQ ID NO: 120226 - DNA, 25 bp, Homo sapien
tttattgtgcatgtccatcctccat

SEQ ID NO: 120227 - DNA, 25 bp, Homo sapien
tttattgtgcatgtccgtcctccat

SEQ ID NO: 120228 - DNA, 25 bp, Homo sapien
tttattgttggagagaaaggttaca

SEQ ID NO: 120229 - DNA, 25 bp, Homo sapien
tttattgttggagcgaaaggttaca

SEQ ID NO: 120230 - DNA, 25 bp, Homo sapien
tttattgtttatttgtaggcattat

SEQ ID NO: 120231 - DNA, 25 bp, Homo sapien
tttattgtttatttgtgggcattat

SEQ ID NO: 120232 - DNA, 25 bp, Homo sapien
tttatttaaccttactaagcctttt

SEQ ID NO: 120233 - DNA, 25 bp, Homo sapien
tttatttaaccttcctaagcctttt

SEQ ID NO: 120234 - DNA, 25 bp, Homo sapien
tttatttaacttaccgctaatctca

SEQ ID NO: 120235 - DNA, 25 bp, Homo sapien
tttatttaacttactgctaatctca

SEQ ID NO: 120236 - DNA, 25 bp, Homo sapien
tttatttagccgtcactatatacca

SEQ ID NO: 120237 - DNA, 25 bp, Homo sapien
tttatttagccttcactatatacca

SEQ ID NO: 120238 - DNA, 25 bp, Homo sapien
tttatttattgcagtatatttttga

SEQ ID NO: 120239 - DNA, 25 bp, Homo sapien
tttatttattggagtatatttttga

SEQ ID NO: 120240 - DNA, 25 bp, Homo sapien
tttatttattttcctgtatcagtgt

SEQ ID NO: 120241 - DNA, 25 bp, Homo sapien
tttatttatttttctgtatcagtgt

SEQ ID NO: 120242 - DNA, 25 bp, Homo sapien
tttatttcactgatgctttatcccc

SEQ ID NO: 120243 - DNA, 25 bp, Homo sapien
tttatttcattgatgctttatcccc

SEQ ID NO: 120244 - DNA, 25 bp, Homo sapien
tttatttcgaagttgcatgtattgt

SEQ ID NO: 120245 - DNA, 25 bp, Homo sapien
tttatttcgaagttgcgtgtattgt

SEQ ID NO: 120246 - DNA, 25 bp, Homo sapien
tttatttcgtctctacaggctgctc

SEQ ID NO: 120247 - DNA, 25 bp, Homo sapien
tttatttctcaaagttctggagaca

SEQ ID NO: 120248 - DNA, 25 bp, Homo sapien
tttatttctcacagtcggaaactct

SEQ ID NO: 120249 - DNA, 25 bp, Homo sapien
tttatttctcacagtctgaaactct

SEQ ID NO: 120250 - DNA, 25 bp, Homo sapien
tttatttctgaaagttctggagaca

SEQ ID NO: 120251 - DNA, 25 bp, Homo sapien
tttatttcttctctacaggctgctc

SEQ ID NO: 120252 - DNA, 25 bp, Homo sapien
tttatttgatttcgcagtctggcta

SEQ ID NO: 120253 - DNA, 25 bp, Homo sapien
tttatttgattttgcagtctggcta

SEQ ID NO: 120254 - DNA, 25 bp, Homo sapien
tttatttgcatattgtggttcaccc

SEQ ID NO: 120255 - DNA, 25 bp, Homo sapien
tttatttgcatgttgtggttcaccc

SEQ ID NO: 120256 - DNA, 25 bp, Homo sapien
tttatttgtaacttttatgagttaa

SEQ ID NO: 120257 - DNA, 25 bp, Homo sapien
tttatttgtaatttttatgagttaa

SEQ ID NO: 120258 - DNA, 25 bp, Homo sapien
tttatttgtagaactgaggtaataa

SEQ ID NO: 120259 - DNA, 25 bp, Homo sapien
tttatttgtagaattgaggtaataa

SEQ ID NO: 120260 - DNA, 25 bp, Homo sapien
tttattttaagctaacatacacaac

SEQ ID NO: 120261 - DNA, 25 bp, Homo sapien
tttattttaaggtaacatacacaac

SEQ ID NO: 120262 - DNA, 25 bp, Homo sapien
tttattttcagttgacttctcaatt

SEQ ID NO: 120263 - DNA, 25 bp, Homo sapien
tttattttcagttgccttctcaatt

SEQ ID NO: 120264 - DNA, 25 bp, Homo sapien
tttattttccacataaatccatcaa

SEQ ID NO: 120265 - DNA, 25 bp, Homo sapien
tttattttccacgtaaatccatcaa

SEQ ID NO: 120266 - DNA, 25 bp, Homo sapien
tttattttcctgtatcagtgtgtta

SEQ ID NO: 120267 - DNA, 25 bp, Homo sapien
tttattttccttctattgaattgtt

SEQ ID NO: 120268 - DNA, 25 bp, Homo sapien
tttattttctttatcccgcatggga

SEQ ID NO: 120269 - DNA, 25 bp, Homo sapien
tttattttctttctattgaattgtt

SEQ ID NO: 120270 - DNA, 25 bp, Homo sapien
tttatttttaagaagatcaaagtag

SEQ ID NO: 120271 - DNA, 25 bp, Homo sapien
tttatttttcataccctgctctcaa

SEQ ID NO: 120272 - DNA, 25 bp, Homo sapien
tttatttttcatacgctgctctcaa

SEQ ID NO: 120273 - DNA, 25 bp, Homo sapien
tttatttttccgcattgttttctag

SEQ ID NO: 120274 - DNA, 25 bp, Homo sapien
tttatttttccgtattgttttctag

SEQ ID NO: 120275 - DNA, 25 bp, Homo sapien
tttatttttctgtatcagtgtgtta

SEQ ID NO: 120276 - DNA, 25 bp, Homo sapien
tttatttttgagaagatcaaagtag

SEQ ID NO: 120277 - DNA, 25 bp, Homo sapien
tttatttttggccttgatatttttc

SEQ ID NO: 120278 - DNA, 25 bp, Homo sapien
tttatttttggccttgctatttttc

SEQ ID NO: 120279 - DNA, 25 bp, Homo sapien
tttattttttttatcccgcatggga

SEQ ID NO: 120280 - DNA, 25 bp, Homo sapien
tttcaaaaaagaaaaactggcaaaa

SEQ ID NO: 120281 - DNA, 25 bp, Homo sapien
tttcaaaaaaggaaaactggcaaaa

SEQ ID NO: 120282 - DNA, 25 bp, Homo sapien
tttcaaaacagggccactccagtct

SEQ ID NO: 120283 - DNA, 25 bp, Homo sapien
tttcaaaacggggccactccagtct

SEQ ID NO: 120284 - DNA, 25 bp, Homo sapien
tttcaaaagtgctaagaatataaat

SEQ ID NO: 120285 - DNA, 25 bp, Homo sapien
tttcaaaagtgctaggaatataaat

SEQ ID NO: 120286 - DNA, 25 bp, Homo sapien
tttcaaaatcaactatttcaagtga

SEQ ID NO: 120287 - DNA, 25 bp, Homo sapien
tttcaaaatcagctatttcaagtga

SEQ ID NO: 120288 - DNA, 25 bp, Homo sapien
tttcaaaattttcaagatggctttg

SEQ ID NO: 120289 - DNA, 25 bp, Homo sapien
tttcaaaattttgaagatggctttg

SEQ ID NO: 120290 - DNA, 25 bp, Homo sapien
tttcaaacattatcaaaatgaaaca

SEQ ID NO: 120291 - DNA, 25 bp, Homo sapien
tttcaaactttatcaaaatgaaaca

SEQ ID NO: 120292 - DNA, 25 bp, Homo sapien
tttcaaagaattagccattgataca

SEQ ID NO: 120293 - DNA, 25 bp, Homo sapien
tttcaaagaattagtcattgataca

SEQ ID NO: 120294 - DNA, 25 bp, Homo sapien
tttcaaagactgtataaaaaaacag

SEQ ID NO: 120295 - DNA, 25 bp, Homo sapien
tttcaaagattgtataaaaaaacag

SEQ ID NO: 120296 - DNA, 25 bp, Homo sapien
tttcaaaggagcagcaccatcctct

SEQ ID NO: 120297 - DNA, 25 bp, Homo sapien
tttcaaaggagcggcaccatcctct

SEQ ID NO: 120298 - DNA, 25 bp, Homo sapien
tttcaaataatgccaggaaatgcat

SEQ ID NO: 120299 - DNA, 25 bp, Homo sapien
tttcaaataatgtcaggaaatgcat

SEQ ID NO: 120300 - DNA, 25 bp, Homo sapien
tttcaaatacaaatcgacaatccag

SEQ ID NO: 120301 - DNA, 25 bp, Homo sapien
tttcaaatacaaattgacaatccag

SEQ ID NO: 120302 - DNA, 25 bp, Homo sapien
tttcaaatattgaataacacatgac

SEQ ID NO: 120303 - DNA, 25 bp, Homo sapien
tttcaaatattgactaacacatgac

SEQ ID NO: 120304 - DNA, 25 bp, Homo sapien
tttcaaatatttaaaaaaatctcag

SEQ ID NO: 120305 - DNA, 25 bp, Homo sapien
tttcaaatattttaaaaaatctcag

SEQ ID NO: 120306 - DNA, 25 bp, Homo sapien
tttcaaatcttaaggcagcattttc

SEQ ID NO: 120307 - DNA, 25 bp, Homo sapien
tttcaaatcttaagtcagcattttc

SEQ ID NO: 120308 - DNA, 25 bp, Homo sapien
tttcaaattcccagaagaccttact

SEQ ID NO: 120309 - DNA, 25 bp, Homo sapien
tttcaaatttccagaagaccttact

SEQ ID NO: 120310 - DNA, 25 bp, Homo sapien
tttcaacaacggctaaaaacatata

SEQ ID NO: 120311 - DNA, 25 bp, Homo sapien
tttcaacaagggctaaaaacatata

SEQ ID NO: 120312 - DNA, 25 bp, Homo sapien
tttcaacacatgcactgcacacatg

SEQ ID NO: 120313 - DNA, 25 bp, Homo sapien
tttcaacacatgcgctgcacacatg

SEQ ID NO: 120314 - DNA, 25 bp, Homo sapien
tttcaacactaaaatttagcgataa

SEQ ID NO: 120315 - DNA, 25 bp, Homo sapien
tttcaacagtaaaatttagcgataa

SEQ ID NO: 120316 - DNA, 25 bp, Homo sapien
tttcaactacagggaaacctattct

SEQ ID NO: 120317 - DNA, 25 bp, Homo sapien
tttcaactacatggaaacctattct

SEQ ID NO: 120318 - DNA, 25 bp, Homo sapien
tttcaactatgatattgcctttggc

SEQ ID NO: 120319 - DNA, 25 bp, Homo sapien
tttcaactatgtgtttaaatctgga

SEQ ID NO: 120320 - DNA, 25 bp, Homo sapien
tttcaactctgatattgcctttggc

SEQ ID NO: 120321 - DNA, 25 bp, Homo sapien
tttcaactgtgtgtttaaatctgga

SEQ ID NO: 120322 - DNA, 25 bp, Homo sapien
tttcaagaacattgaatgcttaaaa

SEQ ID NO: 120323 - DNA, 25 bp, Homo sapien
tttcaagaatcctcacatggctgta

SEQ ID NO: 120324 - DNA, 25 bp, Homo sapien
tttcaagaatcctcacctggctgta

SEQ ID NO: 120325 - DNA, 25 bp, Homo sapien
tttcaagaatcctcatacaaattgt

SEQ ID NO: 120326 - DNA, 25 bp, Homo sapien
tttcaagaatcctcgtacaaattgt

SEQ ID NO: 120327 - DNA, 25 bp, Homo sapien
tttcaagaccattgaatgcttaaaa

SEQ ID NO: 120328 - DNA, 25 bp, Homo sapien
tttcaagactaggaccaagaaatgt

SEQ ID NO: 120329 - DNA, 25 bp, Homo sapien
tttcaagaggaacgcataaataggt

SEQ ID NO: 120330 - DNA, 25 bp, Homo sapien
tttcaagaggaatgcataaataggt

SEQ ID NO: 120331 - DNA, 25 bp, Homo sapien
tttcaagattaggaccaagaaatgt

SEQ ID NO: 120332 - DNA, 25 bp, Homo sapien
tttcaagcacttcaaacttcataaa

SEQ ID NO: 120333 - DNA, 25 bp, Homo sapien
tttcaagcactttaaacttcataaa

SEQ ID NO: 120334 - DNA, 25 bp, Homo sapien
tttcaagctcttcaggaccaagcct

SEQ ID NO: 120335 - DNA, 25 bp, Homo sapien
tttcaagctcttcgggaccaagcct

SEQ ID NO: 120336 - DNA, 25 bp, Homo sapien
tttcaaggatgatcaagttccacca

SEQ ID NO: 120337 - DNA, 25 bp, Homo sapien
tttcaaggatgatcaatttccacca

SEQ ID NO: 120338 - DNA, 25 bp, Homo sapien
tttcaaggttaataccctgatagtg

SEQ ID NO: 120339 - DNA, 25 bp, Homo sapien
tttcaaggttagtaccctgatagtg

SEQ ID NO: 120340 - DNA, 25 bp, Homo sapien
tttcaagtattaacaatcgagtctg

SEQ ID NO: 120341 - DNA, 25 bp, Homo sapien
tttcaagtattagcaatcgagtctg

SEQ ID NO: 120342 - DNA, 25 bp, Homo sapien
tttcaatagaaaagccaatccttta

SEQ ID NO: 120343 - DNA, 25 bp, Homo sapien
tttcaatagaaaagtcaatccttta

SEQ ID NO: 120344 - DNA, 25 bp, Homo sapien
tttcaatagctaatttttactcact

SEQ ID NO: 120345 - DNA, 25 bp, Homo sapien
tttcaatagctattttttactcact

SEQ ID NO: 120346 - DNA, 25 bp, Homo sapien
tttcaatcagccacaagctttcata

SEQ ID NO: 120347 - DNA, 25 bp, Homo sapien
tttcaatcagccgcaagctttcata

SEQ ID NO: 120348 - DNA, 25 bp, Homo sapien
tttcaattaaacttcactgctttca

SEQ ID NO: 120349 - DNA, 25 bp, Homo sapien
tttcaattaaacttcagtgctttca

SEQ ID NO: 120350 - DNA, 25 bp, Homo sapien
tttcaattctttcgggtaaatactc

SEQ ID NO: 120351 - DNA, 25 bp, Homo sapien
tttcaattcttttgggtaaatactc

SEQ ID NO: 120352 - DNA, 25 bp, Homo sapien
tttcacaaaaagtagatttgaagat

SEQ ID NO: 120353 - DNA, 25 bp, Homo sapien
tttcacaaataacataaacaagtta

SEQ ID NO: 120354 - DNA, 25 bp, Homo sapien
tttcacaaataagataaacaagtta

SEQ ID NO: 120355 - DNA, 25 bp, Homo sapien
tttcacaaatgctacctgtgtatgt

SEQ ID NO: 120356 - DNA, 25 bp, Homo sapien
tttcacaaatgttacctgtgtatgt

SEQ ID NO: 120357 - DNA, 25 bp, Homo sapien
tttcacaacaagtagatttgaagat

SEQ ID NO: 120358 - DNA, 25 bp, Homo sapien
tttcacaagtttccaagtggtgctg

SEQ ID NO: 120359 - DNA, 25 bp, Homo sapien
tttcacaagtttcccagtggtgctg

SEQ ID NO: 120360 - DNA, 25 bp, Homo sapien
tttcacaattccagcacgtctcaat

SEQ ID NO: 120361 - DNA, 25 bp, Homo sapien
tttcacaattccagcatgtctcaat

SEQ ID NO: 120362 - DNA, 25 bp, Homo sapien
tttcacagatgagaaaaattagatg

SEQ ID NO: 120363 - DNA, 25 bp, Homo sapien
tttcacagatgggaaaaattagatg

SEQ ID NO: 120364 - DNA, 25 bp, Homo sapien
tttcacagccttagaaatgagatgt

SEQ ID NO: 120365 - DNA, 25 bp, Homo sapien
tttcacagctttagaaatgagatgt

SEQ ID NO: 120366 - DNA, 25 bp, Homo sapien
tttcacagtttttatctatctgaag

SEQ ID NO: 120367 - DNA, 25 bp, Homo sapien
tttcacagtttttgtctatctgaag

SEQ ID NO: 120368 - DNA, 25 bp, Homo sapien
tttcacataaaagcacacgagacca

SEQ ID NO: 120369 - DNA, 25 bp, Homo sapien
tttcacataaaagtacacgagacca

SEQ ID NO: 120370 - DNA, 25 bp, Homo sapien
tttcacatacaacgctttgataaac

SEQ ID NO: 120371 - DNA, 25 bp, Homo sapien
tttcacatacaatgctttgataaac

SEQ ID NO: 120372 - DNA, 25 bp, Homo sapien
tttcacatagttaaccaatcaatca

SEQ ID NO: 120373 - DNA, 25 bp, Homo sapien
tttcacatgacagccctttatactt

SEQ ID NO: 120374 - DNA, 25 bp, Homo sapien
tttcacatggcagccctttatactt

SEQ ID NO: 120375 - DNA, 25 bp, Homo sapien
tttcacatggttaaccaatcaatca

SEQ ID NO: 120376 - DNA, 25 bp, Homo sapien
tttcacatttccctggcttgatttc

SEQ ID NO: 120377 - DNA, 25 bp, Homo sapien
tttcacatttccgacaaagttcttc

SEQ ID NO: 120378 - DNA, 25 bp, Homo sapien
tttcacatttccggcaaagttcttc

SEQ ID NO: 120379 - DNA, 25 bp, Homo sapien
tttcacatttccgtggcttgatttc

SEQ ID NO: 120380 - DNA, 25 bp, Homo sapien
tttcacatttcctcatagtttcacc

SEQ ID NO: 120381 - DNA, 25 bp, Homo sapien
tttcacatttccttatagtttcacc

SEQ ID NO: 120382 - DNA, 25 bp, Homo sapien
tttcaccaggataattgagcagcta

SEQ ID NO: 120383 - DNA, 25 bp, Homo sapien
tttcaccagtataattgagcagcta

SEQ ID NO: 120384 - DNA, 25 bp, Homo sapien
tttcacctaataaacctgtcctact

SEQ ID NO: 120385 - DNA, 25 bp, Homo sapien
tttcacctaataagcctgtcctact

SEQ ID NO: 120386 - DNA, 25 bp, Homo sapien
tttcacctaattctcgtcaggccag

SEQ ID NO: 120387 - DNA, 25 bp, Homo sapien
tttcacctaattcttgtcaggccag

SEQ ID NO: 120388 - DNA, 25 bp, Homo sapien
tttcacctcttcatcattcagaatt

SEQ ID NO: 120389 - DNA, 25 bp, Homo sapien
tttcacctcttcttcattcagaatt

SEQ ID NO: 120390 - DNA, 25 bp, Homo sapien
tttcacctgcgcagtcacaccctag

SEQ ID NO: 120391 - DNA, 25 bp, Homo sapien
tttcacctgggcagtcacaccctag

SEQ ID NO: 120392 - DNA, 25 bp, Homo sapien
tttcacgaagagagccctgaaaaat

SEQ ID NO: 120393 - DNA, 25 bp, Homo sapien
tttcacgaagagagccttgaaaaat

SEQ ID NO: 120394 - DNA, 25 bp, Homo sapien
tttcacgtgccactgtttccaaata

SEQ ID NO: 120395 - DNA, 25 bp, Homo sapien
tttcacgtgtacataggcataccca

SEQ ID NO: 120396 - DNA, 25 bp, Homo sapien
tttcacgtgtacattggcataccca

SEQ ID NO: 120397 - DNA, 25 bp, Homo sapien
tttcacgtgtcactgtttccaaata

SEQ ID NO: 120398 - DNA, 25 bp, Homo sapien
tttcactaatatctgattttccctt

SEQ ID NO: 120399 - DNA, 25 bp, Homo sapien
tttcactaatatttgattttccctt

SEQ ID NO: 120400 - DNA, 25 bp, Homo sapien
tttcactctaccaaaaaaaggcaaa

SEQ ID NO: 120401 - DNA, 25 bp, Homo sapien
tttcactctaccaacaaaaggcaaa

SEQ ID NO: 120402 - DNA, 25 bp, Homo sapien
tttcactggacttattttgctatag

SEQ ID NO: 120403 - DNA, 25 bp, Homo sapien
tttcactgggcttattttgctatag

SEQ ID NO: 120404 - DNA, 25 bp, Homo sapien
tttcacttacacaaaaaatttcgca

SEQ ID NO: 120405 - DNA, 25 bp, Homo sapien
tttcacttacacagaaaatttcgca

SEQ ID NO: 120406 - DNA, 25 bp, Homo sapien
tttcacttacagtacggtagtcaat

SEQ ID NO: 120407 - DNA, 25 bp, Homo sapien
tttcacttcgacctggaggccagtg

SEQ ID NO: 120408 - DNA, 25 bp, Homo sapien
tttcacttcgacttggaggccagtg

SEQ ID NO: 120409 - DNA, 25 bp, Homo sapien
tttcactttcagtacggtagtcaat

SEQ ID NO: 120410 - DNA, 25 bp, Homo sapien
tttcactttgaagtctttttactta

SEQ ID NO: 120411 - DNA, 25 bp, Homo sapien
tttcacttttaaggagtttctgtat

SEQ ID NO: 120412 - DNA, 25 bp, Homo sapien
tttcacttttaagtagtttctgtat

SEQ ID NO: 120413 - DNA, 25 bp, Homo sapien
tttcacttttaagtctttttactta

SEQ ID NO: 120414 - DNA, 25 bp, Homo sapien
tttcagaaaaccggcattctggctg

SEQ ID NO: 120415 - DNA, 25 bp, Homo sapien
tttcagaaaactggcattctggctg

SEQ ID NO: 120416 - DNA, 25 bp, Homo sapien
tttcagaaacaatttgaaccttagc

SEQ ID NO: 120417 - DNA, 25 bp, Homo sapien
tttcagaaacagtttgaaccttagc

SEQ ID NO: 120418 - DNA, 25 bp, Homo sapien
tttcagaaagacagaacagagaaaa

SEQ ID NO: 120419 - DNA, 25 bp, Homo sapien
tttcagaaagacggaacagagaaaa

SEQ ID NO: 120420 - DNA, 25 bp, Homo sapien
tttcagaaagcagtaccttttccat

SEQ ID NO: 120421 - DNA, 25 bp, Homo sapien
tttcagaaagcattaccttttccat

SEQ ID NO: 120422 - DNA, 25 bp, Homo sapien
tttcagaatgggccaagcttaggta

SEQ ID NO: 120423 - DNA, 25 bp, Homo sapien
tttcagaatgggtcaagcttaggta

SEQ ID NO: 120424 - DNA, 25 bp, Homo sapien
tttcagacatttagagctatgttac

SEQ ID NO: 120425 - DNA, 25 bp, Homo sapien
tttcagacgtttagagctatgttac

SEQ ID NO: 120426 - DNA, 25 bp, Homo sapien
tttcagagagagagtattcaaaata

SEQ ID NO: 120427 - DNA, 25 bp, Homo sapien
tttcagagagagggtattcaaaata

SEQ ID NO: 120428 - DNA, 25 bp, Homo sapien
tttcagaggaaaatctgaactgtcc

SEQ ID NO: 120429 - DNA, 25 bp, Homo sapien
tttcagaggaatatctgaactgtcc

SEQ ID NO: 120430 - DNA, 25 bp, Homo sapien
tttcagatacattgtgaagaaaaaa

SEQ ID NO: 120431 - DNA, 25 bp, Homo sapien
tttcagatagattgtgaagaaaaaa

SEQ ID NO: 120432 - DNA, 25 bp, Homo sapien
tttcagcagtcattttcttcaatta

SEQ ID NO: 120433 - DNA, 25 bp, Homo sapien
tttcagcagtctttttcttcaatta

SEQ ID NO: 120434 - DNA, 25 bp, Homo sapien
tttcagcatctgtgagattatttca

SEQ ID NO: 120435 - DNA, 25 bp, Homo sapien
tttcagcatctttgagattatttca

SEQ ID NO: 120436 - DNA, 25 bp, Homo sapien
tttcagccctgatgaatgattttga

SEQ ID NO: 120437 - DNA, 25 bp, Homo sapien
tttcagccctgatgcatgattttga

SEQ ID NO: 120438 - DNA, 25 bp, Homo sapien
tttcagcctctcagcgatctctcgt

SEQ ID NO: 120439 - DNA, 25 bp, Homo sapien
tttcagcctctcagtgatctctcgt

SEQ ID NO: 120440 - DNA, 25 bp, Homo sapien
tttcagccttacagtgggagccttc

SEQ ID NO: 120441 - DNA, 25 bp, Homo sapien
tttcagccttagagtgggagccttc

SEQ ID NO: 120442 - DNA, 25 bp, Homo sapien
tttcagctaaatagagacgttgcag

SEQ ID NO: 120443 - DNA, 25 bp, Homo sapien
tttcagctaaatagaggcgttgcag

SEQ ID NO: 120444 - DNA, 25 bp, Homo sapien
tttcagctcaggccatttttctact

SEQ ID NO: 120445 - DNA, 25 bp, Homo sapien
tttcagctcaggtcatttttctact

SEQ ID NO: 120446 - DNA, 25 bp, Homo sapien
tttcagctctttcattactgtcttt

SEQ ID NO: 120447 - DNA, 25 bp, Homo sapien
tttcagctctttcgttactgtcttt

SEQ ID NO: 120448 - DNA, 25 bp, Homo sapien
tttcagctgcttctggctataggta

SEQ ID NO: 120449 - DNA, 25 bp, Homo sapien
tttcagctgtgtcacatgccttagt

SEQ ID NO: 120450 - DNA, 25 bp, Homo sapien
tttcagctgtgtcatatgccttagt

SEQ ID NO: 120451 - DNA, 25 bp, Homo sapien
tttcagctgttagtatgatatgctg

SEQ ID NO: 120452 - DNA, 25 bp, Homo sapien
tttcagctgttagtgtgatatgctg

SEQ ID NO: 120453 - DNA, 25 bp, Homo sapien
tttcagcttcttctggctataggta

SEQ ID NO: 120454 - DNA, 25 bp, Homo sapien
tttcaggaatgaagctgagtcccaa

SEQ ID NO: 120455 - DNA, 25 bp, Homo sapien
tttcaggaatgaggctgagtcccaa

SEQ ID NO: 120456 - DNA, 25 bp, Homo sapien
tttcaggattccctggtatttttaa

SEQ ID NO: 120457 - DNA, 25 bp, Homo sapien
tttcaggattccttggtatttttaa

SEQ ID NO: 120458 - DNA, 25 bp, Homo sapien
tttcaggcaagcacattacatgagt

SEQ ID NO: 120459 - DNA, 25 bp, Homo sapien
tttcaggcaagcatattacatgagt

SEQ ID NO: 120460 - DNA, 25 bp, Homo sapien
tttcaggcaatctgacatactagag

SEQ ID NO: 120461 - DNA, 25 bp, Homo sapien
tttcaggccacaatgctaggaggaa

SEQ ID NO: 120462 - DNA, 25 bp, Homo sapien
tttcaggccacagtgctaggaggaa

SEQ ID NO: 120463 - DNA, 25 bp, Homo sapien
tttcaggcgatctgacatactagag

SEQ ID NO: 120464 - DNA, 25 bp, Homo sapien
tttcaggctacataattctttgttg

SEQ ID NO: 120465 - DNA, 25 bp, Homo sapien
tttcaggctacctaattctttgttg

SEQ ID NO: 120466 - DNA, 25 bp, Homo sapien
tttcagggatccacgtagaagttgc

SEQ ID NO: 120467 - DNA, 25 bp, Homo sapien
tttcagggatccatgtagaagttgc

SEQ ID NO: 120468 - DNA, 25 bp, Homo sapien
tttcaggtataaaggcaggcgagac

SEQ ID NO: 120469 - DNA, 25 bp, Homo sapien
tttcaggtataaagtcaggcgagac

SEQ ID NO: 120470 - DNA, 25 bp, Homo sapien
tttcaggtggagcaaatgcttattt

SEQ ID NO: 120471 - DNA, 25 bp, Homo sapien
tttcaggtgttcactagttcctatc

SEQ ID NO: 120472 - DNA, 25 bp, Homo sapien
tttcaggtgttcgctagttcctatc

SEQ ID NO: 120473 - DNA, 25 bp, Homo sapien
tttcaggttgagcaaatgcttattt

SEQ ID NO: 120474 - DNA, 25 bp, Homo sapien
tttcagtaaaaggaaagagtaagcc

SEQ ID NO: 120475 - DNA, 25 bp, Homo sapien
tttcagtaaaatgaaagagtaagcc

SEQ ID NO: 120476 - DNA, 25 bp, Homo sapien
tttcagtaatggtaaaatagctcct

SEQ ID NO: 120477 - DNA, 25 bp, Homo sapien
tttcagtaatggtaaagtagctcct

SEQ ID NO: 120478 - DNA, 25 bp, Homo sapien
tttcagtattaaaataggctggaaa

SEQ ID NO: 120479 - DNA, 25 bp, Homo sapien
tttcagtattaacataggctggaaa

SEQ ID NO: 120480 - DNA, 25 bp, Homo sapien
tttcagtcactaatggggcttcatc

SEQ ID NO: 120481 - DNA, 25 bp, Homo sapien
tttcagtcactactggggcttcatc

SEQ ID NO: 120482 - DNA, 25 bp, Homo sapien
tttcagtgagtacacagtcaacacc

SEQ ID NO: 120483 - DNA, 25 bp, Homo sapien
tttcagtgcgtacacagtcaacacc

SEQ ID NO: 120484 - DNA, 25 bp, Homo sapien
tttcagtggactatataatgtagtt

SEQ ID NO: 120485 - DNA, 25 bp, Homo sapien
tttcagtggactgtataatgtagtt

SEQ ID NO: 120486 - DNA, 25 bp, Homo sapien
tttcagtgtagatcgaacagccttc

SEQ ID NO: 120487 - DNA, 25 bp, Homo sapien
tttcagtgtagatcgaccagccttc

SEQ ID NO: 120488 - DNA, 25 bp, Homo sapien
tttcagttaaggttctcttggcaca

SEQ ID NO: 120489 - DNA, 25 bp, Homo sapien
tttcagttcatcaattgaattttac

SEQ ID NO: 120490 - DNA, 25 bp, Homo sapien
tttcagttcatcatttgaattttac

SEQ ID NO: 120491 - DNA, 25 bp, Homo sapien
tttcagttccgactctaacttgtga

SEQ ID NO: 120492 - DNA, 25 bp, Homo sapien
tttcagttccgcctctaacttgtga

SEQ ID NO: 120493 - DNA, 25 bp, Homo sapien
tttcagttgacttctcaattttcta

SEQ ID NO: 120494 - DNA, 25 bp, Homo sapien
tttcagttgaggttctcttggcaca

SEQ ID NO: 120495 - DNA, 25 bp, Homo sapien
tttcagttgccttctcaattttcta

SEQ ID NO: 120496 - DNA, 25 bp, Homo sapien
tttcagtttaatagctgagaaataa

SEQ ID NO: 120497 - DNA, 25 bp, Homo sapien
tttcagtttaatggctgagaaataa

SEQ ID NO: 120498 - DNA, 25 bp, Homo sapien
tttcagtttcaattcagtttctttt

SEQ ID NO: 120499 - DNA, 25 bp, Homo sapien
tttcagtttcagttcagtttctttt

SEQ ID NO: 120500 - DNA, 25 bp, Homo sapien
tttcagttttatggttcgatacatt

SEQ ID NO: 120501 - DNA, 25 bp, Homo sapien
tttcagttttatggtttgatacatt

SEQ ID NO: 120502 - DNA, 25 bp, Homo sapien
tttcatacacctcataaaaacttca

SEQ ID NO: 120503 - DNA, 25 bp, Homo sapien
tttcatacacctcgtaaaaacttca

SEQ ID NO: 120504 - DNA, 25 bp, Homo sapien
tttcatacaggttagacaacagtga

SEQ ID NO: 120505 - DNA, 25 bp, Homo sapien
tttcatacaggttagagaacagtga

SEQ ID NO: 120506 - DNA, 25 bp, Homo sapien
tttcatactttcacagaactgtaac

SEQ ID NO: 120507 - DNA, 25 bp, Homo sapien
tttcatactttcatagaactgtaac

SEQ ID NO: 120508 - DNA, 25 bp, Homo sapien
tttcatagtaaccattgcatttttt

SEQ ID NO: 120509 - DNA, 25 bp, Homo sapien
tttcatagtaaccgttgcatttttt

SEQ ID NO: 120510 - DNA, 25 bp, Homo sapien
tttcatatgctcacatgacatctgt

SEQ ID NO: 120511 - DNA, 25 bp, Homo sapien
tttcatatgcttacatgacatctgt

SEQ ID NO: 120512 - DNA, 25 bp, Homo sapien
tttcatattagacctgcgttctacc

SEQ ID NO: 120513 - DNA, 25 bp, Homo sapien
tttcatattagacctgtgttctacc

SEQ ID NO: 120514 - DNA, 25 bp, Homo sapien
tttcatcaatataatatacatgcag

SEQ ID NO: 120515 - DNA, 25 bp, Homo sapien
tttcatcaattaggtttttttgttt

SEQ ID NO: 120516 - DNA, 25 bp, Homo sapien
tttcatcaattagttttttttgttt

SEQ ID NO: 120517 - DNA, 25 bp, Homo sapien
tttcatcagccaaaaagaaagaatc

SEQ ID NO: 120518 - DNA, 25 bp, Homo sapien
tttcatcagccataaagaaagaatc

SEQ ID NO: 120519 - DNA, 25 bp, Homo sapien
tttcatcagtaattacaacatggaa

SEQ ID NO: 120520 - DNA, 25 bp, Homo sapien
tttcatcagtaattccaacatggaa

SEQ ID NO: 120521 - DNA, 25 bp, Homo sapien
tttcatcagtataatatacatgcag

SEQ ID NO: 120522 - DNA, 25 bp, Homo sapien
tttcatcatcacatttgtcaccatt

SEQ ID NO: 120523 - DNA, 25 bp, Homo sapien
tttcatcatcacgtttgtcaccatt

SEQ ID NO: 120524 - DNA, 25 bp, Homo sapien
tttcatcatctgatctcatcattct

SEQ ID NO: 120525 - DNA, 25 bp, Homo sapien
tttcatcatctggtctcatcattct

SEQ ID NO: 120526 - DNA, 25 bp, Homo sapien
tttcatcccacaaattcgaatcttt

SEQ ID NO: 120527 - DNA, 25 bp, Homo sapien
tttcatcctacaaattcgaatcttt

SEQ ID NO: 120528 - DNA, 25 bp, Homo sapien
tttcatcctttcacattttgacaca

SEQ ID NO: 120529 - DNA, 25 bp, Homo sapien
tttcatcctttcaccttttgacaca

SEQ ID NO: 120530 - DNA, 25 bp, Homo sapien
tttcatctataaaacaggttctttg

SEQ ID NO: 120531 - DNA, 25 bp, Homo sapien
tttcatctataaaagaggttctttg

SEQ ID NO: 120532 - DNA, 25 bp, Homo sapien
tttcatctgcctgctccttaaataa

SEQ ID NO: 120533 - DNA, 25 bp, Homo sapien
tttcatctgtctgctccttaaataa

SEQ ID NO: 120534 - DNA, 25 bp, Homo sapien
tttcatcttacccgcacatggctac

SEQ ID NO: 120535 - DNA, 25 bp, Homo sapien
tttcatcttacctgcacatggctac

SEQ ID NO: 120536 - DNA, 25 bp, Homo sapien
tttcatgaccgaggctccatcatga

SEQ ID NO: 120537 - DNA, 25 bp, Homo sapien
tttcatgactgaggctccatcatga

SEQ ID NO: 120538 - DNA, 25 bp, Homo sapien
tttcatgactgcaatgactgctcct

SEQ ID NO: 120539 - DNA, 25 bp, Homo sapien
tttcatgactggaatgactgctcct

SEQ ID NO: 120540 - DNA, 25 bp, Homo sapien
tttcatgagctacaaaaggttgcaa

SEQ ID NO: 120541 - DNA, 25 bp, Homo sapien
tttcatgagctacagaaggttgcaa

SEQ ID NO: 120542 - DNA, 25 bp, Homo sapien
tttcatgattaccaagtggcagagc

SEQ ID NO: 120543 - DNA, 25 bp, Homo sapien
tttcatgattagcaagtggcagagc

SEQ ID NO: 120544 - DNA, 25 bp, Homo sapien
tttcatgctagattccaacttgttc

SEQ ID NO: 120545 - DNA, 25 bp, Homo sapien
tttcatgctgacgaacgtttgagtt

SEQ ID NO: 120546 - DNA, 25 bp, Homo sapien
tttcatgctgatgaacgtttgagtt

SEQ ID NO: 120547 - DNA, 25 bp, Homo sapien
tttcatgctgccggccactgaaagc

SEQ ID NO: 120548 - DNA, 25 bp, Homo sapien
tttcatgctgctggccactgaaagc

SEQ ID NO: 120549 - DNA, 25 bp, Homo sapien
tttcatgctggattccaacttgttc

SEQ ID NO: 120550 - DNA, 25 bp, Homo sapien
tttcatggaagataagttgaaagat

SEQ ID NO: 120551 - DNA, 25 bp, Homo sapien
tttcatggagatttgtgagtaacag

SEQ ID NO: 120552 - DNA, 25 bp, Homo sapien
tttcatggagatttttgagtaacag

SEQ ID NO: 120553 - DNA, 25 bp, Homo sapien
tttcatggctttttatcatttgttg

SEQ ID NO: 120554 - DNA, 25 bp, Homo sapien
tttcatgggagataagttgaaagat

SEQ ID NO: 120555 - DNA, 25 bp, Homo sapien
tttcatggttttttatcatttgttg

SEQ ID NO: 120556 - DNA, 25 bp, Homo sapien
tttcatgtttgcttttcatttgtca

SEQ ID NO: 120557 - DNA, 25 bp, Homo sapien
tttcatgtttgctttttatttgtca

SEQ ID NO: 120558 - DNA, 25 bp, Homo sapien
tttcattcacatggaaccttcaact

SEQ ID NO: 120559 - DNA, 25 bp, Homo sapien
tttcattcacatggaatcttcaact

SEQ ID NO: 120560 - DNA, 25 bp, Homo sapien
tttcattccacatctcctttctgca

SEQ ID NO: 120561 - DNA, 25 bp, Homo sapien
tttcattccacatctcttttctgca

SEQ ID NO: 120562 - DNA, 25 bp, Homo sapien
tttcattgaaagtctcctccaaatc

SEQ ID NO: 120563 - DNA, 25 bp, Homo sapien
tttcattgagcaaatcatcaaactc

SEQ ID NO: 120564 - DNA, 25 bp, Homo sapien
tttcattgagcaagtcatcaaactc

SEQ ID NO: 120565 - DNA, 25 bp, Homo sapien
tttcattgctctctatcaatacctg

SEQ ID NO: 120566 - DNA, 25 bp, Homo sapien
tttcattgctctctgtcaatacctg

SEQ ID NO: 120567 - DNA, 25 bp, Homo sapien
tttcattggaagtctcctccaaatc

SEQ ID NO: 120568 - DNA, 25 bp, Homo sapien
tttcattgtgggaattttaagcatt

SEQ ID NO: 120569 - DNA, 25 bp, Homo sapien
tttcattgtgggagttttaagcatt

SEQ ID NO: 120570 - DNA, 25 bp, Homo sapien
tttcattgttgctcttgatggtttt

SEQ ID NO: 120571 - DNA, 25 bp, Homo sapien
tttcattgttgcttttgatggtttt

SEQ ID NO: 120572 - DNA, 25 bp, Homo sapien
tttcatttaattgaatcaccggttt

SEQ ID NO: 120573 - DNA, 25 bp, Homo sapien
tttcatttatttgaatcaccggttt

SEQ ID NO: 120574 - DNA, 25 bp, Homo sapien
tttcatttctgtgttgggtcacttt

SEQ ID NO: 120575 - DNA, 25 bp, Homo sapien
tttcatttctgttttgggtcacttt

SEQ ID NO: 120576 - DNA, 25 bp, Homo sapien
tttcatttcttgtgacacctaactt

SEQ ID NO: 120577 - DNA, 25 bp, Homo sapien
tttcatttcttgtggcacctaactt

SEQ ID NO: 120578 - DNA, 25 bp, Homo sapien
tttcatttgtctcaaggaattttta

SEQ ID NO: 120579 - DNA, 25 bp, Homo sapien
tttcatttgtctcgaggaattttta

SEQ ID NO: 120580 - DNA, 25 bp, Homo sapien
tttcattttagtaaccttgaactaa

SEQ ID NO: 120581 - DNA, 25 bp, Homo sapien
tttcattttggtaaccttgaactaa

SEQ ID NO: 120582 - DNA, 25 bp, Homo sapien
tttcattttgtattcctgctctgta

SEQ ID NO: 120583 - DNA, 25 bp, Homo sapien
tttcattttgtatttctgctctgta

SEQ ID NO: 120584 - DNA, 25 bp, Homo sapien
tttccaaaaggtcatatcatactgc

SEQ ID NO: 120585 - DNA, 25 bp, Homo sapien
tttccaaaaggtcgtatcatactgc

SEQ ID NO: 120586 - DNA, 25 bp, Homo sapien
tttccaaaatagctgcctaaaatga

SEQ ID NO: 120587 - DNA, 25 bp, Homo sapien
tttccaaaataggtgcctaaaatga

SEQ ID NO: 120588 - DNA, 25 bp, Homo sapien
tttccaaaattcatctcaaattaag

SEQ ID NO: 120589 - DNA, 25 bp, Homo sapien
tttccaaaattcgtctcaaattaag

SEQ ID NO: 120590 - DNA, 25 bp, Homo sapien
tttccaaacttattgtactaccagt

SEQ ID NO: 120591 - DNA, 25 bp, Homo sapien
tttccaaacttcacgatcgggtagt

SEQ ID NO: 120592 - DNA, 25 bp, Homo sapien
tttccaaacttcatgatcgggtagt

SEQ ID NO: 120593 - DNA, 25 bp, Homo sapien
tttccaaatagctgaactgtaaacc

SEQ ID NO: 120594 - DNA, 25 bp, Homo sapien
tttccaaatagttgaactgtaaacc

SEQ ID NO: 120595 - DNA, 25 bp, Homo sapien
tttccaaatttattgtactaccagt

SEQ ID NO: 120596 - DNA, 25 bp, Homo sapien
tttccaaccgattgaaattcaactc

SEQ ID NO: 120597 - DNA, 25 bp, Homo sapien
tttccaaccgattgaagttcaactc

SEQ ID NO: 120598 - DNA, 25 bp, Homo sapien
tttccaagagaaataagcagtcaca

SEQ ID NO: 120599 - DNA, 25 bp, Homo sapien
tttccaagagaattaagcagtcaca

SEQ ID NO: 120600 - DNA, 25 bp, Homo sapien
tttccaagcgcggtcggctgtgtca

SEQ ID NO: 120601 - DNA, 25 bp, Homo sapien
tttccaagcgcggttggctgtgtca

SEQ ID NO: 120602 - DNA, 25 bp, Homo sapien
tttccaaggagacagtggatggctg

SEQ ID NO: 120603 - DNA, 25 bp, Homo sapien
tttccaaggagagagtggatggctg

SEQ ID NO: 120604 - DNA, 25 bp, Homo sapien
tttccaaggcaccactgttaaatag

SEQ ID NO: 120605 - DNA, 25 bp, Homo sapien
tttccaaggtaccactgttaaatag

SEQ ID NO: 120606 - DNA, 25 bp, Homo sapien
tttccaagtgggtatagcaagctgg

SEQ ID NO: 120607 - DNA, 25 bp, Homo sapien
tttccaagtggttatagcaagctgg

SEQ ID NO: 120608 - DNA, 25 bp, Homo sapien
tttccaatagagtgagcagttgtcc

SEQ ID NO: 120609 - DNA, 25 bp, Homo sapien
tttccaatggagtgagcagttgtcc

SEQ ID NO: 120610 - DNA, 25 bp, Homo sapien
tttccaatggccatacatttactaa

SEQ ID NO: 120611 - DNA, 25 bp, Homo sapien
tttccaatggccttacatttactaa

SEQ ID NO: 120612 - DNA, 25 bp, Homo sapien
tttccacaacggtatttggctacac

SEQ ID NO: 120613 - DNA, 25 bp, Homo sapien
tttccacaatggtatttggctacac

SEQ ID NO: 120614 - DNA, 25 bp, Homo sapien
tttccacagatttttgctcatgctg

SEQ ID NO: 120615 - DNA, 25 bp, Homo sapien
tttccacagctttttgctcatgctg

SEQ ID NO: 120616 - DNA, 25 bp, Homo sapien
tttccacatattacgtcatttaact

SEQ ID NO: 120617 - DNA, 25 bp, Homo sapien
tttccacatattatgtcatttaact

SEQ ID NO: 120618 - DNA, 25 bp, Homo sapien
tttccacatattcgatttgctaatt

SEQ ID NO: 120619 - DNA, 25 bp, Homo sapien
tttccacatatttgatttgctaatt

SEQ ID NO: 120620 - DNA, 25 bp, Homo sapien
tttccacattgtcttccttgtgctg

SEQ ID NO: 120621 - DNA, 25 bp, Homo sapien
tttccacattgtcttctttgtgctg

SEQ ID NO: 120622 - DNA, 25 bp, Homo sapien
tttccacgtctctcagtttctgtgt

SEQ ID NO: 120623 - DNA, 25 bp, Homo sapien
tttccacgtctttcagtttctgtgt

SEQ ID NO: 120624 - DNA, 25 bp, Homo sapien
tttccactgaacgatctttttatct

SEQ ID NO: 120625 - DNA, 25 bp, Homo sapien
tttccactgaatgatctttttatct

SEQ ID NO: 120626 - DNA, 25 bp, Homo sapien
tttccacttagctgaaaccaccata

SEQ ID NO: 120627 - DNA, 25 bp, Homo sapien
tttccacttagctgaatccaccata

SEQ ID NO: 120628 - DNA, 25 bp, Homo sapien
tttccagaatctctttgatcgctcc

SEQ ID NO: 120629 - DNA, 25 bp, Homo sapien
tttccagagcaggtaatgtcagacc

SEQ ID NO: 120630 - DNA, 25 bp, Homo sapien
tttccagagtaggtaatgtcagacc

SEQ ID NO: 120631 - DNA, 25 bp, Homo sapien
tttccagagtctctttgatcgctcc

SEQ ID NO: 120632 - DNA, 25 bp, Homo sapien
tttccaggcttacagaggaggcaca

SEQ ID NO: 120633 - DNA, 25 bp, Homo sapien
tttccagggcttagaatgtggatag

SEQ ID NO: 120634 - DNA, 25 bp, Homo sapien
tttccagggtttagaatgtggatag

SEQ ID NO: 120635 - DNA, 25 bp, Homo sapien
tttccaggtccatgttttcagaggc

SEQ ID NO: 120636 - DNA, 25 bp, Homo sapien
tttccaggtccattttttcagaggc

SEQ ID NO: 120637 - DNA, 25 bp, Homo sapien
tttccaggtttacagaggaggcaca

SEQ ID NO: 120638 - DNA, 25 bp, Homo sapien
tttccataaacagcagaaagccatt

SEQ ID NO: 120639 - DNA, 25 bp, Homo sapien
tttccataagcagcagaaagccatt

SEQ ID NO: 120640 - DNA, 25 bp, Homo sapien
tttccataccacactctcttcacta

SEQ ID NO: 120641 - DNA, 25 bp, Homo sapien
tttccataccacagtctcttcacta

SEQ ID NO: 120642 - DNA, 25 bp, Homo sapien
tttccatcaaacataataaatccac

SEQ ID NO: 120643 - DNA, 25 bp, Homo sapien
tttccatcaaacgtaataaatccac

SEQ ID NO: 120644 - DNA, 25 bp, Homo sapien
tttccatcagaatttgagtagcttc

SEQ ID NO: 120645 - DNA, 25 bp, Homo sapien
tttccatcagtgtagcctaatctac

SEQ ID NO: 120646 - DNA, 25 bp, Homo sapien
tttccatcagtgtcgcctaatctac

SEQ ID NO: 120647 - DNA, 25 bp, Homo sapien
tttccatccttaaagacagaatagg

SEQ ID NO: 120648 - DNA, 25 bp, Homo sapien
tttccatccttaaatacagaatagg

SEQ ID NO: 120649 - DNA, 25 bp, Homo sapien
tttccatcggaatttgagtagcttc

SEQ ID NO: 120650 - DNA, 25 bp, Homo sapien
tttccatctcaattgtacagacaac

SEQ ID NO: 120651 - DNA, 25 bp, Homo sapien
tttccatctgaattgtacagacaac

SEQ ID NO: 120652 - DNA, 25 bp, Homo sapien
tttccatgagagagaaaaaaacaga

SEQ ID NO: 120653 - DNA, 25 bp, Homo sapien
tttccatgcaccaataaaattcctt

SEQ ID NO: 120654 - DNA, 25 bp, Homo sapien
tttccatgggagagaaaaaaacaga

SEQ ID NO: 120655 - DNA, 25 bp, Homo sapien
tttccatgtaccaataaaattcctt

SEQ ID NO: 120656 - DNA, 25 bp, Homo sapien
tttccatgttaaccctactaccaca

SEQ ID NO: 120657 - DNA, 25 bp, Homo sapien
tttccatgttaaccttactaccaca

SEQ ID NO: 120658 - DNA, 25 bp, Homo sapien
tttccattattcccattgttggttt

SEQ ID NO: 120659 - DNA, 25 bp, Homo sapien
tttccattattcccgttgttggttt

SEQ ID NO: 120660 - DNA, 25 bp, Homo sapien
tttccattcccagaggagagaaacc

SEQ ID NO: 120661 - DNA, 25 bp, Homo sapien
tttccattcccggaggagagaaacc

SEQ ID NO: 120662 - DNA, 25 bp, Homo sapien
tttccattgagatacgtattacatg

SEQ ID NO: 120663 - DNA, 25 bp, Homo sapien
tttccattgagatatgtattacatg

SEQ ID NO: 120664 - DNA, 25 bp, Homo sapien
tttccatttatatgaaattcaataa

SEQ ID NO: 120665 - DNA, 25 bp, Homo sapien
tttccatttatgtgaaattcaataa

SEQ ID NO: 120666 - DNA, 25 bp, Homo sapien
tttccatttgagatacagctctgga

SEQ ID NO: 120667 - DNA, 25 bp, Homo sapien
tttccatttgagttacagctctgga

SEQ ID NO: 120668 - DNA, 25 bp, Homo sapien
tttccatttgggatgactaaaaagt

SEQ ID NO: 120669 - DNA, 25 bp, Homo sapien
tttccatttgggatgattaaaaagt

SEQ ID NO: 120670 - DNA, 25 bp, Homo sapien
tttcccaaattattcgtcattggca

SEQ ID NO: 120671 - DNA, 25 bp, Homo sapien
tttcccaaattatttgtcattggca

SEQ ID NO: 120672 - DNA, 25 bp, Homo sapien
tttcccaagttaaggcaaatttcaa

SEQ ID NO: 120673 - DNA, 25 bp, Homo sapien
tttcccaagttaagtcaaatttcaa

SEQ ID NO: 120674 - DNA, 25 bp, Homo sapien
tttcccaagttcataggtagtaaca

SEQ ID NO: 120675 - DNA, 25 bp, Homo sapien
tttcccaagttcatagttagtaaca

SEQ ID NO: 120676 - DNA, 25 bp, Homo sapien
tttcccaatcttatagacaatgagc

SEQ ID NO: 120677 - DNA, 25 bp, Homo sapien
tttcccaatgttatagacaatgagc

SEQ ID NO: 120678 - DNA, 25 bp, Homo sapien
tttcccaatttgcgtttttatttgc

SEQ ID NO: 120679 - DNA, 25 bp, Homo sapien
tttcccaatttgtgtttttatttgc

SEQ ID NO: 120680 - DNA, 25 bp, Homo sapien
tttcccaggagccactgcaaatgat

SEQ ID NO: 120681 - DNA, 25 bp, Homo sapien
tttcccaggagccattgcaaatgat

SEQ ID NO: 120682 - DNA, 25 bp, Homo sapien
tttcccaggtgaacgaaccctagct

SEQ ID NO: 120683 - DNA, 25 bp, Homo sapien
tttcccaggtgaactaaccctagct

SEQ ID NO: 120684 - DNA, 25 bp, Homo sapien
tttcccagtgatcacactatttcac

SEQ ID NO: 120685 - DNA, 25 bp, Homo sapien
tttcccagtgatcatactatttcac

SEQ ID NO: 120686 - DNA, 25 bp, Homo sapien
tttcccattcgtattgcttatcata

SEQ ID NO: 120687 - DNA, 25 bp, Homo sapien
tttcccattctactcaaagcatgat

SEQ ID NO: 120688 - DNA, 25 bp, Homo sapien
tttcccatttgtattgcttatcata

SEQ ID NO: 120689 - DNA, 25 bp, Homo sapien
tttcccattttactcaaagcatgat

SEQ ID NO: 120690 - DNA, 25 bp, Homo sapien
tttccccaggtcatttgggttttcc

SEQ ID NO: 120691 - DNA, 25 bp, Homo sapien
tttccccaggtcgtttgggttttcc

SEQ ID NO: 120692 - DNA, 25 bp, Homo sapien
tttcccgattatctctgtttcatgt

SEQ ID NO: 120693 - DNA, 25 bp, Homo sapien
tttcccgattatgtctgtttcatgt

SEQ ID NO: 120694 - DNA, 25 bp, Homo sapien
tttcccgctaccttctattttggtc

SEQ ID NO: 120695 - DNA, 25 bp, Homo sapien
tttcccgctaccttctgttttggtc

SEQ ID NO: 120696 - DNA, 25 bp, Homo sapien
tttcccgttcaatctatcttatgag

SEQ ID NO: 120697 - DNA, 25 bp, Homo sapien
tttcccgttgaatctatcttatgag

SEQ ID NO: 120698 - DNA, 25 bp, Homo sapien
tttccctaagtggtaaaatcttgat

SEQ ID NO: 120699 - DNA, 25 bp, Homo sapien
tttccctaagtggtaagatcttgat

SEQ ID NO: 120700 - DNA, 25 bp, Homo sapien
tttccctatccttgaaaaatgatag

SEQ ID NO: 120701 - DNA, 25 bp, Homo sapien
tttccctatccttgaacaatgatag

SEQ ID NO: 120702 - DNA, 25 bp, Homo sapien
tttccctcgagcccttggatatttt

SEQ ID NO: 120703 - DNA, 25 bp, Homo sapien
tttccctcgggcccttggatatttt

SEQ ID NO: 120704 - DNA, 25 bp, Homo sapien
tttccctgcacaatccaggtccttg

SEQ ID NO: 120705 - DNA, 25 bp, Homo sapien
tttccctgcacgatccaggtccttg

SEQ ID NO: 120706 - DNA, 25 bp, Homo sapien
tttcccttaccagtccggcgttcct

SEQ ID NO: 120707 - DNA, 25 bp, Homo sapien
tttcccttatcagtccggcgttcct

SEQ ID NO: 120708 - DNA, 25 bp, Homo sapien
tttccgacattccgtattagacata

SEQ ID NO: 120709 - DNA, 25 bp, Homo sapien
tttccgacattctgtattagacata

SEQ ID NO: 120710 - DNA, 25 bp, Homo sapien
tttccgtcactccgaaaacatgaag

SEQ ID NO: 120711 - DNA, 25 bp, Homo sapien
tttccgtcactctgaaaacatgaag

SEQ ID NO: 120712 - DNA, 25 bp, Homo sapien
tttccgtctctgccatcatgacaga

SEQ ID NO: 120713 - DNA, 25 bp, Homo sapien
tttccgtctctgccttcatgacaga

SEQ ID NO: 120714 - DNA, 25 bp, Homo sapien
tttccgtgattacggactattgccc

SEQ ID NO: 120715 - DNA, 25 bp, Homo sapien
tttccgtgattatggactattgccc

SEQ ID NO: 120716 - DNA, 25 bp, Homo sapien
tttcctaaactgcaattcctccaga

SEQ ID NO: 120717 - DNA, 25 bp, Homo sapien
tttcctaaactgcacttcctccaga

SEQ ID NO: 120718 - DNA, 25 bp, Homo sapien
tttcctaacctctaaggcatttcag

SEQ ID NO: 120719 - DNA, 25 bp, Homo sapien
tttcctaacctctgaggcatttcag

SEQ ID NO: 120720 - DNA, 25 bp, Homo sapien
tttcctaattacttcaccaaaatca

SEQ ID NO: 120721 - DNA, 25 bp, Homo sapien
tttcctaattatttcaccaaaatca

SEQ ID NO: 120722 - DNA, 25 bp, Homo sapien
tttcctacttaatttctgtatgatt

SEQ ID NO: 120723 - DNA, 25 bp, Homo sapien
tttcctacttatgctcgcatttcag

SEQ ID NO: 120724 - DNA, 25 bp, Homo sapien
tttcctacttatgctctcatttcag

SEQ ID NO: 120725 - DNA, 25 bp, Homo sapien
tttcctacttattttctgtatgatt

SEQ ID NO: 120726 - DNA, 25 bp, Homo sapien
tttcctagagcccgtgagccgggaa

SEQ ID NO: 120727 - DNA, 25 bp, Homo sapien
tttcctagagcctgtgagccgggaa

SEQ ID NO: 120728 - DNA, 25 bp, Homo sapien
tttcctatcaaattgtgttacaaca

SEQ ID NO: 120729 - DNA, 25 bp, Homo sapien
tttcctatcaatttgtgttacaaca

SEQ ID NO: 120730 - DNA, 25 bp, Homo sapien
tttcctatgataccgtatcttctgg

SEQ ID NO: 120731 - DNA, 25 bp, Homo sapien
tttcctatgatactgtatcttctgg

SEQ ID NO: 120732 - DNA, 25 bp, Homo sapien
tttcctcaaacagttcctgctaatg

SEQ ID NO: 120733 - DNA, 25 bp, Homo sapien
tttcctcaaacatttcctgctaatg

SEQ ID NO: 120734 - DNA, 25 bp, Homo sapien
tttcctcaaatccattaaatttttc

SEQ ID NO: 120735 - DNA, 25 bp, Homo sapien
tttcctcaaatccgttaaatttttc

SEQ ID NO: 120736 - DNA, 25 bp, Homo sapien
tttcctcaagggatcaaatcaaacc

SEQ ID NO: 120737 - DNA, 25 bp, Homo sapien
tttcctcaatggatcaaatcaaacc

SEQ ID NO: 120738 - DNA, 25 bp, Homo sapien
tttcctcacgtggcagaaagggcaa

SEQ ID NO: 120739 - DNA, 25 bp, Homo sapien
tttcctcacttggcagaaagggcaa

SEQ ID NO: 120740 - DNA, 25 bp, Homo sapien
tttcctcatgaactggcattctttc

SEQ ID NO: 120741 - DNA, 25 bp, Homo sapien
tttcctcatgaattggcattctttc

SEQ ID NO: 120742 - DNA, 25 bp, Homo sapien
tttcctccaaatgactccataagat

SEQ ID NO: 120743 - DNA, 25 bp, Homo sapien
tttcctccacatgactccataagat

SEQ ID NO: 120744 - DNA, 25 bp, Homo sapien
tttcctcccacccagaatagtacca

SEQ ID NO: 120745 - DNA, 25 bp, Homo sapien
tttcctcccaccgagaatagtacca

SEQ ID NO: 120746 - DNA, 25 bp, Homo sapien
tttcctccgtgttctctaacctggt

SEQ ID NO: 120747 - DNA, 25 bp, Homo sapien
tttcctccttgttctctaacctggt

SEQ ID NO: 120748 - DNA, 25 bp, Homo sapien
tttcctctaacttgctttgtctcta

SEQ ID NO: 120749 - DNA, 25 bp, Homo sapien
tttcctctaacttgttttgtctcta

SEQ ID NO: 120750 - DNA, 25 bp, Homo sapien
tttcctctcgttctaatggcaaagt

SEQ ID NO: 120751 - DNA, 25 bp, Homo sapien
tttcctctctttctaatggcaaagt

SEQ ID NO: 120752 - DNA, 25 bp, Homo sapien
tttcctcttcattgtcaaaactacc

SEQ ID NO: 120753 - DNA, 25 bp, Homo sapien
tttcctcttcattttcaaaactacc

SEQ ID NO: 120754 - DNA, 25 bp, Homo sapien
tttcctcttctcaaaagtacctggc

SEQ ID NO: 120755 - DNA, 25 bp, Homo sapien
tttcctcttctccaaagtacctggc

SEQ ID NO: 120756 - DNA, 25 bp, Homo sapien
tttcctctttgctctgttatttatt

SEQ ID NO: 120757 - DNA, 25 bp, Homo sapien
tttcctctttgctgtgttatttatt

SEQ ID NO: 120758 - DNA, 25 bp, Homo sapien
tttcctgaacaaacacctctgagct

SEQ ID NO: 120759 - DNA, 25 bp, Homo sapien
tttcctgacccaacggaatctactt

SEQ ID NO: 120760 - DNA, 25 bp, Homo sapien
tttcctgacccaatggaatctactt

SEQ ID NO: 120761 - DNA, 25 bp, Homo sapien
tttcctgactttgctcacagtgggc

SEQ ID NO: 120762 - DNA, 25 bp, Homo sapien
tttcctgactttggtcacagtgggc

SEQ ID NO: 120763 - DNA, 25 bp, Homo sapien
tttcctgagacaactcctggtgata

SEQ ID NO: 120764 - DNA, 25 bp, Homo sapien
tttcctgagaccactcctggtgata

SEQ ID NO: 120765 - DNA, 25 bp, Homo sapien
tttcctgagcaaacacctctgagct

SEQ ID NO: 120766 - DNA, 25 bp, Homo sapien
tttcctgagcaatactggtgctaag

SEQ ID NO: 120767 - DNA, 25 bp, Homo sapien
tttcctgagcaatagtggtgctaag

SEQ ID NO: 120768 - DNA, 25 bp, Homo sapien
tttcctgaggcacctgtttggaatc

SEQ ID NO: 120769 - DNA, 25 bp, Homo sapien
tttcctgaggccacattcttacagc

SEQ ID NO: 120770 - DNA, 25 bp, Homo sapien
tttcctgaggccgcattcttacagc

SEQ ID NO: 120771 - DNA, 25 bp, Homo sapien
tttcctgaggcgcctgtttggaatc

SEQ ID NO: 120772 - DNA, 25 bp, Homo sapien
tttcctgaggctctcttagaatact

SEQ ID NO: 120773 - DNA, 25 bp, Homo sapien
tttcctgaggctgtcttagaatact

SEQ ID NO: 120774 - DNA, 25 bp, Homo sapien
tttcctgatgataaatcaagttgag

SEQ ID NO: 120775 - DNA, 25 bp, Homo sapien
tttcctgatgataaatgaagttgag

SEQ ID NO: 120776 - DNA, 25 bp, Homo sapien
tttcctgatgtcaaatctaaaaatc

SEQ ID NO: 120777 - DNA, 25 bp, Homo sapien
tttcctgatgtcaagtctaaaaatc

SEQ ID NO: 120778 - DNA, 25 bp, Homo sapien
tttcctgcaaagatatttttcactt

SEQ ID NO: 120779 - DNA, 25 bp, Homo sapien
tttcctgcagacaagactgcttctg

SEQ ID NO: 120780 - DNA, 25 bp, Homo sapien
tttcctgcagataagactgcttctg

SEQ ID NO: 120781 - DNA, 25 bp, Homo sapien
tttcctgcgaagatatttttcactt

SEQ ID NO: 120782 - DNA, 25 bp, Homo sapien
tttcctgcttacctcacatggtaaa

SEQ ID NO: 120783 - DNA, 25 bp, Homo sapien
tttcctgcttacgtcacatggtaaa

SEQ ID NO: 120784 - DNA, 25 bp, Homo sapien
tttcctggaatctgtctgaagtgta

SEQ ID NO: 120785 - DNA, 25 bp, Homo sapien
tttcctggcagcatgccgtgagagt

SEQ ID NO: 120786 - DNA, 25 bp, Homo sapien
tttcctggcagcatgctgtgagagt

SEQ ID NO: 120787 - DNA, 25 bp, Homo sapien
tttcctggcagctgtccattccggc

SEQ ID NO: 120788 - DNA, 25 bp, Homo sapien
tttcctggcagttgtccattccggc

SEQ ID NO: 120789 - DNA, 25 bp, Homo sapien
tttcctgggatctgtctgaagtgta

SEQ ID NO: 120790 - DNA, 25 bp, Homo sapien
tttcctgggcgatagaagcatcttt

SEQ ID NO: 120791 - DNA, 25 bp, Homo sapien
tttcctgggtgatagaagcatcttt

SEQ ID NO: 120792 - DNA, 25 bp, Homo sapien
tttcctggtctttcaaagccatctc

SEQ ID NO: 120793 - DNA, 25 bp, Homo sapien
tttcctggtctttcgaagccatctc

SEQ ID NO: 120794 - DNA, 25 bp, Homo sapien
tttcctggttcgggctaacaaattg

SEQ ID NO: 120795 - DNA, 25 bp, Homo sapien
tttcctggttcgggctgacaaattg

SEQ ID NO: 120796 - DNA, 25 bp, Homo sapien
tttcctgtcatgccaccttgctccc

SEQ ID NO: 120797 - DNA, 25 bp, Homo sapien
tttcctgtcatgccgccttgctccc

SEQ ID NO: 120798 - DNA, 25 bp, Homo sapien
tttccttaaggtcccatcatctttt

SEQ ID NO: 120799 - DNA, 25 bp, Homo sapien
tttccttaaggtccgatcatctttt

SEQ ID NO: 120800 - DNA, 25 bp, Homo sapien
tttccttaatttcctcactgccata

SEQ ID NO: 120801 - DNA, 25 bp, Homo sapien
tttccttaattttctcactgccata

SEQ ID NO: 120802 - DNA, 25 bp, Homo sapien
tttccttacctattgcccattaggc

SEQ ID NO: 120803 - DNA, 25 bp, Homo sapien
tttccttacctgttgcccattaggc

SEQ ID NO: 120804 - DNA, 25 bp, Homo sapien
tttccttacgttgctaatacaaggc

SEQ ID NO: 120805 - DNA, 25 bp, Homo sapien
tttccttactgcaggacttcagttt

SEQ ID NO: 120806 - DNA, 25 bp, Homo sapien
tttccttactgggagagaccagaga

SEQ ID NO: 120807 - DNA, 25 bp, Homo sapien
tttccttaggcccatatcctaattt

SEQ ID NO: 120808 - DNA, 25 bp, Homo sapien
tttccttaggcccgtatcctaattt

SEQ ID NO: 120809 - DNA, 25 bp, Homo sapien
tttccttatgttgctaatacaaggc

SEQ ID NO: 120810 - DNA, 25 bp, Homo sapien
tttccttattgcaggacttcagttt

SEQ ID NO: 120811 - DNA, 25 bp, Homo sapien
tttccttattgggagagaccagaga

SEQ ID NO: 120812 - DNA, 25 bp, Homo sapien
tttccttatttctctcagccttcat

SEQ ID NO: 120813 - DNA, 25 bp, Homo sapien
tttccttatttgtctcagccttcat

SEQ ID NO: 120814 - DNA, 25 bp, Homo sapien
tttccttcatcagcatatatgcaaa

SEQ ID NO: 120815 - DNA, 25 bp, Homo sapien
tttccttcatcggcatatatgcaaa

SEQ ID NO: 120816 - DNA, 25 bp, Homo sapien
tttccttccagctgatgaaattcca

SEQ ID NO: 120817 - DNA, 25 bp, Homo sapien
tttccttccaggtgatgaaattcca

SEQ ID NO: 120818 - DNA, 25 bp, Homo sapien
tttccttccgataggtttttccaag

SEQ ID NO: 120819 - DNA, 25 bp, Homo sapien
tttccttcctacatatttgacctgt

SEQ ID NO: 120820 - DNA, 25 bp, Homo sapien
tttccttcctacgtatttgacctgt

SEQ ID NO: 120821 - DNA, 25 bp, Homo sapien
tttccttcctggaatttgtccaatt

SEQ ID NO: 120822 - DNA, 25 bp, Homo sapien
tttccttctcaccacagagaactgg

SEQ ID NO: 120823 - DNA, 25 bp, Homo sapien
tttccttctcactacagagaactgg

SEQ ID NO: 120824 - DNA, 25 bp, Homo sapien
tttccttctgataggtttttccaag

SEQ ID NO: 120825 - DNA, 25 bp, Homo sapien
tttccttcttggaatttgtccaatt

SEQ ID NO: 120826 - DNA, 25 bp, Homo sapien
tttccttgacacgctaccgctagac

SEQ ID NO: 120827 - DNA, 25 bp, Homo sapien
tttccttgacatgctaccgctagac

SEQ ID NO: 120828 - DNA, 25 bp, Homo sapien
tttccttgaccccattattgatgtc

SEQ ID NO: 120829 - DNA, 25 bp, Homo sapien
tttccttgaccccattgttgatgtc

SEQ ID NO: 120830 - DNA, 25 bp, Homo sapien
tttccttgagcacagtaaggagagt

SEQ ID NO: 120831 - DNA, 25 bp, Homo sapien
tttccttgagcacggtaaggagagt

SEQ ID NO: 120832 - DNA, 25 bp, Homo sapien
tttccttgagtaatgaatgcaatga

SEQ ID NO: 120833 - DNA, 25 bp, Homo sapien
tttccttgagtgactgacctctctt

SEQ ID NO: 120834 - DNA, 25 bp, Homo sapien
tttccttgagtgattgacctctctt

SEQ ID NO: 120835 - DNA, 25 bp, Homo sapien
tttccttgcactgggcagcctgatg

SEQ ID NO: 120836 - DNA, 25 bp, Homo sapien
tttccttgcgctgggcagcctgatg

SEQ ID NO: 120837 - DNA, 25 bp, Homo sapien
tttccttgctcatctcagatctgcc

SEQ ID NO: 120838 - DNA, 25 bp, Homo sapien
tttccttgctcgtctcagatctgcc

SEQ ID NO: 120839 - DNA, 25 bp, Homo sapien
tttccttgctttctttcctgtattg

SEQ ID NO: 120840 - DNA, 25 bp, Homo sapien
tttccttgctttcttttctgtattg

SEQ ID NO: 120841 - DNA, 25 bp, Homo sapien
tttccttggctaacttcttcgagtg

SEQ ID NO: 120842 - DNA, 25 bp, Homo sapien
tttccttgggtaatgaatgcaatga

SEQ ID NO: 120843 - DNA, 25 bp, Homo sapien
tttccttggttaacttcttcgagtg

SEQ ID NO: 120844 - DNA, 25 bp, Homo sapien
tttcctttaatgcaatgggtttcct

SEQ ID NO: 120845 - DNA, 25 bp, Homo sapien
tttcctttaatgcagtgggtttcct

SEQ ID NO: 120846 - DNA, 25 bp, Homo sapien
tttcctttcctctcgttctaatggc

SEQ ID NO: 120847 - DNA, 25 bp, Homo sapien
tttcctttcctctctttctaatggc

SEQ ID NO: 120848 - DNA, 25 bp, Homo sapien
tttcctttctcagccgtcttctacc

SEQ ID NO: 120849 - DNA, 25 bp, Homo sapien
tttcctttctcagtcgtcttctacc

SEQ ID NO: 120850 - DNA, 25 bp, Homo sapien
tttccttttacaaacttacagaaac

SEQ ID NO: 120851 - DNA, 25 bp, Homo sapien
tttccttttacaaatttacagaaac

SEQ ID NO: 120852 - DNA, 25 bp, Homo sapien
tttccttttctaccatacgtcacaa

SEQ ID NO: 120853 - DNA, 25 bp, Homo sapien
tttccttttctaccatgcgtcacaa

SEQ ID NO: 120854 - DNA, 25 bp, Homo sapien
tttccttttgaaattcctaggtaag

SEQ ID NO: 120855 - DNA, 25 bp, Homo sapien
tttccttttgaagtagatgtttatc

SEQ ID NO: 120856 - DNA, 25 bp, Homo sapien
tttccttttgaagttcctaggtaag

SEQ ID NO: 120857 - DNA, 25 bp, Homo sapien
tttccttttgaggtagatgtttatc

SEQ ID NO: 120858 - DNA, 25 bp, Homo sapien
tttcctttttctcgtcacttgtagt

SEQ ID NO: 120859 - DNA, 25 bp, Homo sapien
tttcctttttcttgtcacttgtagt

SEQ ID NO: 120860 - DNA, 25 bp, Homo sapien
tttcgaacttggccttccaggtgga

SEQ ID NO: 120861 - DNA, 25 bp, Homo sapien
tttcgaacttggcctttcaggtgga

SEQ ID NO: 120862 - DNA, 25 bp, Homo sapien
tttcgaagaagcacagatgtccaga

SEQ ID NO: 120863 - DNA, 25 bp, Homo sapien
tttcgaagaagcgcagatgtccaga

SEQ ID NO: 120864 - DNA, 25 bp, Homo sapien
tttcgaagttgcatgtattgtgtta

SEQ ID NO: 120865 - DNA, 25 bp, Homo sapien
tttcgaagttgcgtgtattgtgtta

SEQ ID NO: 120866 - DNA, 25 bp, Homo sapien
tttcgagttagagagaagagagttt

SEQ ID NO: 120867 - DNA, 25 bp, Homo sapien
tttcgagttcgagagaagagagttt

SEQ ID NO: 120868 - DNA, 25 bp, Homo sapien
tttcgatatggatcacatgggtata

SEQ ID NO: 120869 - DNA, 25 bp, Homo sapien
tttcgatatggatcacgtgggtata

SEQ ID NO: 120870 - DNA, 25 bp, Homo sapien
tttcgcaaaaggtactcgctgccaa

SEQ ID NO: 120871 - DNA, 25 bp, Homo sapien
tttcgcaaaagttactcgctgccaa

SEQ ID NO: 120872 - DNA, 25 bp, Homo sapien
tttcgcaatttgatcatgaaatttt

SEQ ID NO: 120873 - DNA, 25 bp, Homo sapien
tttcgcaatttggtcatgaaatttt

SEQ ID NO: 120874 - DNA, 25 bp, Homo sapien
tttcgccgattcattaaaataatcg

SEQ ID NO: 120875 - DNA, 25 bp, Homo sapien
tttcgccgattcgttaaaataatcg

SEQ ID NO: 120876 - DNA, 25 bp, Homo sapien
tttcggaacgtgctgatctcagagg

SEQ ID NO: 120877 - DNA, 25 bp, Homo sapien
tttcggaatgtgctgatctcagagg

SEQ ID NO: 120878 - DNA, 25 bp, Homo sapien
tttcggcttcatagacatcttggca

SEQ ID NO: 120879 - DNA, 25 bp, Homo sapien
tttcggcttcattgacatcttggca

SEQ ID NO: 120880 - DNA, 25 bp, Homo sapien
tttcgggcattacacttattatcca

SEQ ID NO: 120881 - DNA, 25 bp, Homo sapien
tttcgggcattatacttattatcca

SEQ ID NO: 120882 - DNA, 25 bp, Homo sapien
tttcggtgaattccacagtggccat

SEQ ID NO: 120883 - DNA, 25 bp, Homo sapien
tttcggtgaattccacggtggccat

SEQ ID NO: 120884 - DNA, 25 bp, Homo sapien
tttcggtttggcatagcacattgtg

SEQ ID NO: 120885 - DNA, 25 bp, Homo sapien
tttcggtttggcgtagcacattgtg

SEQ ID NO: 120886 - DNA, 25 bp, Homo sapien
tttcgtaacgctatttctgccatag

SEQ ID NO: 120887 - DNA, 25 bp, Homo sapien
tttcgtaatgctatttctgccatag

SEQ ID NO: 120888 - DNA, 25 bp, Homo sapien
tttcgtaggtatcaacatattttat

SEQ ID NO: 120889 - DNA, 25 bp, Homo sapien
tttcgtaggtatcaacgtattttat

SEQ ID NO: 120890 - DNA, 25 bp, Homo sapien
tttcgtatgactttcggttcttttt

SEQ ID NO: 120891 - DNA, 25 bp, Homo sapien
tttcgtatgacttttggttcttttt

SEQ ID NO: 120892 - DNA, 25 bp, Homo sapien
tttctaaaactatgcaactcccatg

SEQ ID NO: 120893 - DNA, 25 bp, Homo sapien
tttctaaaagcaataaactcatttg

SEQ ID NO: 120894 - DNA, 25 bp, Homo sapien
tttctaaaagcaataagctcatttg

SEQ ID NO: 120895 - DNA, 25 bp, Homo sapien
tttctaaaattatgcaactcccatg

SEQ ID NO: 120896 - DNA, 25 bp, Homo sapien
tttctaaacaacccttccatgtcca

SEQ ID NO: 120897 - DNA, 25 bp, Homo sapien
tttctaaacaacctttccatgtcca

SEQ ID NO: 120898 - DNA, 25 bp, Homo sapien
tttctaaatgctgaatagctcccct

SEQ ID NO: 120899 - DNA, 25 bp, Homo sapien
tttctaaatgctgcatagctcccct

SEQ ID NO: 120900 - DNA, 25 bp, Homo sapien
tttctaaccacaagatttttttctg

SEQ ID NO: 120901 - DNA, 25 bp, Homo sapien
tttctaaccacaaggtttttttctg

SEQ ID NO: 120902 - DNA, 25 bp, Homo sapien
tttctaatagtactccatcatagag

SEQ ID NO: 120903 - DNA, 25 bp, Homo sapien
tttctaatagtacttcatcatagag

SEQ ID NO: 120904 - DNA, 25 bp, Homo sapien
tttctaatccattgaccgatggccc

SEQ ID NO: 120905 - DNA, 25 bp, Homo sapien
tttctaatccattgactgatggccc

SEQ ID NO: 120906 - DNA, 25 bp, Homo sapien
tttctaattcttcctcactatcttc

SEQ ID NO: 120907 - DNA, 25 bp, Homo sapien
tttctaattcttcctcgctatcttc

SEQ ID NO: 120908 - DNA, 25 bp, Homo sapien
tttctacaactcccgagtccactct

SEQ ID NO: 120909 - DNA, 25 bp, Homo sapien
tttctacaacttacactacaccaac

SEQ ID NO: 120910 - DNA, 25 bp, Homo sapien
tttctacaaggacaattctttgcct

SEQ ID NO: 120911 - DNA, 25 bp, Homo sapien
tttctacaaggacagttctttgcct

SEQ ID NO: 120912 - DNA, 25 bp, Homo sapien
tttctacaataatctgaactgtaag

SEQ ID NO: 120913 - DNA, 25 bp, Homo sapien
tttctacaataatttgaactgtaag

SEQ ID NO: 120914 - DNA, 25 bp, Homo sapien
tttctacacagagtgaaggagaaag

SEQ ID NO: 120915 - DNA, 25 bp, Homo sapien
tttctacacagggtgaaggagaaag

SEQ ID NO: 120916 - DNA, 25 bp, Homo sapien
tttctacacctcccgagtccactct

SEQ ID NO: 120917 - DNA, 25 bp, Homo sapien
tttctacaccttacactacaccaac

SEQ ID NO: 120918 - DNA, 25 bp, Homo sapien
tttctacagagtaacaaaacaaaac

SEQ ID NO: 120919 - DNA, 25 bp, Homo sapien
tttctacagagtgacaaaacaaaac

SEQ ID NO: 120920 - DNA, 25 bp, Homo sapien
tttctacagcacaacctagcatatc

SEQ ID NO: 120921 - DNA, 25 bp, Homo sapien
tttctacagcataacctagcatatc

SEQ ID NO: 120922 - DNA, 25 bp, Homo sapien
tttctacagttctgatttcattctc

SEQ ID NO: 120923 - DNA, 25 bp, Homo sapien
tttctacagttttgatttcattctc

SEQ ID NO: 120924 - DNA, 25 bp, Homo sapien
tttctaccatcatagcccaagccat

SEQ ID NO: 120925 - DNA, 25 bp, Homo sapien
tttctaccatcgtagcccaagccat

SEQ ID NO: 120926 - DNA, 25 bp, Homo sapien
tttctacctaagggtaatcttctac

SEQ ID NO: 120927 - DNA, 25 bp, Homo sapien
tttctacctaagtgtaatcttctac

SEQ ID NO: 120928 - DNA, 25 bp, Homo sapien
tttctactcagcttcaaactctcag

SEQ ID NO: 120929 - DNA, 25 bp, Homo sapien
tttctactctttagcatacagatct

SEQ ID NO: 120930 - DNA, 25 bp, Homo sapien
tttctactgaaagacactgaaataa

SEQ ID NO: 120931 - DNA, 25 bp, Homo sapien
tttctactgaaaggcactgaaataa

SEQ ID NO: 120932 - DNA, 25 bp, Homo sapien
tttctacttagcttcaaactctcag

SEQ ID NO: 120933 - DNA, 25 bp, Homo sapien
tttctactttttagcatacagatct

SEQ ID NO: 120934 - DNA, 25 bp, Homo sapien
tttctaggctatcatgcagtgaggg

SEQ ID NO: 120935 - DNA, 25 bp, Homo sapien
tttctaggctatgatgcagtgaggg

SEQ ID NO: 120936 - DNA, 25 bp, Homo sapien
tttctagtaaaaattctaaacagtg

SEQ ID NO: 120937 - DNA, 25 bp, Homo sapien
tttctagtaaagattctaaacagtg

SEQ ID NO: 120938 - DNA, 25 bp, Homo sapien
tttctagtagactcgagctgctgtg

SEQ ID NO: 120939 - DNA, 25 bp, Homo sapien
tttctagtagacttgagctgctgtg

SEQ ID NO: 120940 - DNA, 25 bp, Homo sapien
tttctagtagtataaagttcccagg

SEQ ID NO: 120941 - DNA, 25 bp, Homo sapien
tttctagtagtatgaagttcccagg

SEQ ID NO: 120942 - DNA, 25 bp, Homo sapien
tttctagttaactcgaggattttct

SEQ ID NO: 120943 - DNA, 25 bp, Homo sapien
tttctagttaactcgatgattttct

SEQ ID NO: 120944 - DNA, 25 bp, Homo sapien
tttctagttttttatcatgtgatat

SEQ ID NO: 120945 - DNA, 25 bp, Homo sapien
tttctagttttttatcgtgtgatat

SEQ ID NO: 120946 - DNA, 25 bp, Homo sapien
tttctataaaagacatagatcacct

SEQ ID NO: 120947 - DNA, 25 bp, Homo sapien
tttctataaaagacgtagatcacct

SEQ ID NO: 120948 - DNA, 25 bp, Homo sapien
tttctatagccaagtagtaggaaac

SEQ ID NO: 120949 - DNA, 25 bp, Homo sapien
tttctataggcaagtagtaggaaac

SEQ ID NO: 120950 - DNA, 25 bp, Homo sapien
tttctatagttactgaacattgaat

SEQ ID NO: 120951 - DNA, 25 bp, Homo sapien
tttctatagttattgaacattgaat

SEQ ID NO: 120952 - DNA, 25 bp, Homo sapien
tttctatatagaaaaagaagttgga

SEQ ID NO: 120953 - DNA, 25 bp, Homo sapien
tttctatatagagaaagaagttgga

SEQ ID NO: 120954 - DNA, 25 bp, Homo sapien
tttctatcaccattgcaaacctgat

SEQ ID NO: 120955 - DNA, 25 bp, Homo sapien
tttctatcaccgttgcaaacctgat

SEQ ID NO: 120956 - DNA, 25 bp, Homo sapien
tttctatccagctgttatttttgta

SEQ ID NO: 120957 - DNA, 25 bp, Homo sapien
tttctatccagctgttctttttgta

SEQ ID NO: 120958 - DNA, 25 bp, Homo sapien
tttctatccatctttgcttcaaggt

SEQ ID NO: 120959 - DNA, 25 bp, Homo sapien
tttctatccgtctttgcttcaaggt

SEQ ID NO: 120960 - DNA, 25 bp, Homo sapien
tttctatgcctgagattgagaaggg

SEQ ID NO: 120961 - DNA, 25 bp, Homo sapien
tttctatgcctgagtttgagaaggg

SEQ ID NO: 120962 - DNA, 25 bp, Homo sapien
tttctatgcgtatatggtcaacatg

SEQ ID NO: 120963 - DNA, 25 bp, Homo sapien
tttctatggcaaccttgacagctca

SEQ ID NO: 120964 - DNA, 25 bp, Homo sapien
tttctatggcaatcttgacagctca

SEQ ID NO: 120965 - DNA, 25 bp, Homo sapien
tttctatggcccaaccaatgctttc

SEQ ID NO: 120966 - DNA, 25 bp, Homo sapien
tttctatggcccaaccgatgctttc

SEQ ID NO: 120967 - DNA, 25 bp, Homo sapien
tttctatgtgtatatggtcaacatg

SEQ ID NO: 120968 - DNA, 25 bp, Homo sapien
tttctattaaagtggcaatgcacca

SEQ ID NO: 120969 - DNA, 25 bp, Homo sapien
tttctattaaagtggccatgcacca

SEQ ID NO: 120970 - DNA, 25 bp, Homo sapien
tttctattcctcaacaagccaaatt

SEQ ID NO: 120971 - DNA, 25 bp, Homo sapien
tttctattcctcaacaggccaaatt

SEQ ID NO: 120972 - DNA, 25 bp, Homo sapien
tttctattccttttggagttgtttt

SEQ ID NO: 120973 - DNA, 25 bp, Homo sapien
tttctattctggatgctaagaataa

SEQ ID NO: 120974 - DNA, 25 bp, Homo sapien
tttctattctggttgctaagaataa

SEQ ID NO: 120975 - DNA, 25 bp, Homo sapien
tttctattcttacgtggtagaacgc

SEQ ID NO: 120976 - DNA, 25 bp, Homo sapien
tttctattcttatgtggtagaacgc

SEQ ID NO: 120977 - DNA, 25 bp, Homo sapien
tttctattgataactatcctcaccc

SEQ ID NO: 120978 - DNA, 25 bp, Homo sapien
tttctattgatatctatcctcaccc

SEQ ID NO: 120979 - DNA, 25 bp, Homo sapien
tttctatttcttttggagttgtttt

SEQ ID NO: 120980 - DNA, 25 bp, Homo sapien
tttctcaacgattcaacctaacagg

SEQ ID NO: 120981 - DNA, 25 bp, Homo sapien
tttctcaagttttgttatcaatatt

SEQ ID NO: 120982 - DNA, 25 bp, Homo sapien
tttctcaagttttgttgtcaatatt

SEQ ID NO: 120983 - DNA, 25 bp, Homo sapien
tttctcaatcttcaaatgagtctga

SEQ ID NO: 120984 - DNA, 25 bp, Homo sapien
tttctcaatctttaaatgagtctga

SEQ ID NO: 120985 - DNA, 25 bp, Homo sapien
tttctcaatgattcaacctaacagg

SEQ ID NO: 120986 - DNA, 25 bp, Homo sapien
tttctcacagtcggaaactctaaga

SEQ ID NO: 120987 - DNA, 25 bp, Homo sapien
tttctcacagtctgaaactctaaga

SEQ ID NO: 120988 - DNA, 25 bp, Homo sapien
tttctcagaaataatgttttccaat

SEQ ID NO: 120989 - DNA, 25 bp, Homo sapien
tttctcagaaatagtgttttccaat

SEQ ID NO: 120990 - DNA, 25 bp, Homo sapien
tttctcagagagtactcagatcagt

SEQ ID NO: 120991 - DNA, 25 bp, Homo sapien
tttctcagaggttattaataccagc

SEQ ID NO: 120992 - DNA, 25 bp, Homo sapien
tttctcagaggttgttaataccagc

SEQ ID NO: 120993 - DNA, 25 bp, Homo sapien
tttctcagatacaggacatataaac

SEQ ID NO: 120994 - DNA, 25 bp, Homo sapien
tttctcagatagtactcagatcagt

SEQ ID NO: 120995 - DNA, 25 bp, Homo sapien
tttctcagatataggacatataaac

SEQ ID NO: 120996 - DNA, 25 bp, Homo sapien
tttctcagccgtcttctacctccag

SEQ ID NO: 120997 - DNA, 25 bp, Homo sapien
tttctcagctagatttcaactagag

SEQ ID NO: 120998 - DNA, 25 bp, Homo sapien
tttctcagctaggtttcaactagag

SEQ ID NO: 120999 - DNA, 25 bp, Homo sapien
tttctcagctcctctttgacaggag

SEQ ID NO: 121000 - DNA, 25 bp, Homo sapien
tttctcagctcgtctttgacaggag

SEQ ID NO: 121001 - DNA, 25 bp, Homo sapien
tttctcagtcgtcttctacctccag

SEQ ID NO: 121002 - DNA, 25 bp, Homo sapien
tttctcatagtagcacatgactttg

SEQ ID NO: 121003 - DNA, 25 bp, Homo sapien
tttctcatagtagcacgtgactttg

SEQ ID NO: 121004 - DNA, 25 bp, Homo sapien
tttctcatccacatttacccagggc

SEQ ID NO: 121005 - DNA, 25 bp, Homo sapien
tttctcatccacatttgcccagggc

SEQ ID NO: 121006 - DNA, 25 bp, Homo sapien
tttctcatctacaaaaataggtagg

SEQ ID NO: 121007 - DNA, 25 bp, Homo sapien
tttctcatctacaaaactaggtagg

SEQ ID NO: 121008 - DNA, 25 bp, Homo sapien
tttctcatctctactctctctcaaa

SEQ ID NO: 121009 - DNA, 25 bp, Homo sapien
tttctcatctctattctctctcaaa

SEQ ID NO: 121010 - DNA, 25 bp, Homo sapien
tttctcatgcctaagtgacagtgct

SEQ ID NO: 121011 - DNA, 25 bp, Homo sapien
tttctcatggctaagtgacagtgct

SEQ ID NO: 121012 - DNA, 25 bp, Homo sapien
tttctcatttacagtccttttgcat

SEQ ID NO: 121013 - DNA, 25 bp, Homo sapien
tttctcatttacggtccttttgcat

SEQ ID NO: 121014 - DNA, 25 bp, Homo sapien
tttctccaaaatatacagtctctgt

SEQ ID NO: 121015 - DNA, 25 bp, Homo sapien
tttctccactctgaatacccagtga

SEQ ID NO: 121016 - DNA, 25 bp, Homo sapien
tttctccactctgagtacccagtga

SEQ ID NO: 121017 - DNA, 25 bp, Homo sapien
tttctccagaatatacagtctctgt

SEQ ID NO: 121018 - DNA, 25 bp, Homo sapien
tttctccagcggcagaaatctttta

SEQ ID NO: 121019 - DNA, 25 bp, Homo sapien
tttctccagtggcagaaatctttta

SEQ ID NO: 121020 - DNA, 25 bp, Homo sapien
tttctccatgtcacctttcaccaag

SEQ ID NO: 121021 - DNA, 25 bp, Homo sapien
tttctccatgtcacgtttcaccaag

SEQ ID NO: 121022 - DNA, 25 bp, Homo sapien
tttctccatttcattctagttgctg

SEQ ID NO: 121023 - DNA, 25 bp, Homo sapien
tttctccattttattctagttgctg

SEQ ID NO: 121024 - DNA, 25 bp, Homo sapien
tttctcctcattggcacaatatgca

SEQ ID NO: 121025 - DNA, 25 bp, Homo sapien
tttctcctcattggcagaatatgca

SEQ ID NO: 121026 - DNA, 25 bp, Homo sapien
tttctcgccgctagtgttctgagat

SEQ ID NO: 121027 - DNA, 25 bp, Homo sapien
tttctcgctgctagtgttctgagat

SEQ ID NO: 121028 - DNA, 25 bp, Homo sapien
tttctctagtgtccttcttaagaag

SEQ ID NO: 121029 - DNA, 25 bp, Homo sapien
tttctctagtgttcttcttaagaag

SEQ ID NO: 121030 - DNA, 25 bp, Homo sapien
tttctctatcaccgtaggccctgat

SEQ ID NO: 121031 - DNA, 25 bp, Homo sapien
tttctctatcactgtaggccctgat

SEQ ID NO: 121032 - DNA, 25 bp, Homo sapien
tttctctcaggctgctctctgcctg

SEQ ID NO: 121033 - DNA, 25 bp, Homo sapien
tttctctccaacaactacctgctct

SEQ ID NO: 121034 - DNA, 25 bp, Homo sapien
tttctctccaacaattacctgctct

SEQ ID NO: 121035 - DNA, 25 bp, Homo sapien
tttctctccggctgctctctgcctg

SEQ ID NO: 121036 - DNA, 25 bp, Homo sapien
tttctctcctaaacgctggtataat

SEQ ID NO: 121037 - DNA, 25 bp, Homo sapien
tttctctctatatatatgcacatct

SEQ ID NO: 121038 - DNA, 25 bp, Homo sapien
tttctctctcacgttatatgtgtgc

SEQ ID NO: 121039 - DNA, 25 bp, Homo sapien
tttctctctcatgttatatgtgtgc

SEQ ID NO: 121040 - DNA, 25 bp, Homo sapien
tttctctctctatatatgcacatct

SEQ ID NO: 121041 - DNA, 25 bp, Homo sapien
tttctctctgacagtcccattgaaa

SEQ ID NO: 121042 - DNA, 25 bp, Homo sapien
tttctctcttaaacgctggtataat

SEQ ID NO: 121043 - DNA, 25 bp, Homo sapien
tttctctcttacagtcccattgaaa

SEQ ID NO: 121044 - DNA, 25 bp, Homo sapien
tttctctctttggatatcaaggtct

SEQ ID NO: 121045 - DNA, 25 bp, Homo sapien
tttctctctttgggtatcaaggtct

SEQ ID NO: 121046 - DNA, 25 bp, Homo sapien
tttctctgactcaattatgtggaaa

SEQ ID NO: 121047 - DNA, 25 bp, Homo sapien
tttctctgactcgattatgtggaaa

SEQ ID NO: 121048 - DNA, 25 bp, Homo sapien
tttctctgatagaatacatgttcca

SEQ ID NO: 121049 - DNA, 25 bp, Homo sapien
tttctctgatagactacatgttcca

SEQ ID NO: 121050 - DNA, 25 bp, Homo sapien
tttctctgatcctcttccttgtttc

SEQ ID NO: 121051 - DNA, 25 bp, Homo sapien
tttctctgatccttttccttgtttc

SEQ ID NO: 121052 - DNA, 25 bp, Homo sapien
tttctctgcctttcaccttcttagt

SEQ ID NO: 121053 - DNA, 25 bp, Homo sapien
tttctctgcctttcgccttcttagt

SEQ ID NO: 121054 - DNA, 25 bp, Homo sapien
tttctcttacaaggacactgtgatt

SEQ ID NO: 121055 - DNA, 25 bp, Homo sapien
tttctcttataaggacactgtgatt

SEQ ID NO: 121056 - DNA, 25 bp, Homo sapien
tttctcttattgcaaaattctattg

SEQ ID NO: 121057 - DNA, 25 bp, Homo sapien
tttctcttatttcaaaattctattg

SEQ ID NO: 121058 - DNA, 25 bp, Homo sapien
tttctcttctacgactaatcctaca

SEQ ID NO: 121059 - DNA, 25 bp, Homo sapien
tttctcttctatgactaatcctaca

SEQ ID NO: 121060 - DNA, 25 bp, Homo sapien
tttctcttcttgctattgtcagaca

SEQ ID NO: 121061 - DNA, 25 bp, Homo sapien
tttctcttcttgctgttgtcagaca

SEQ ID NO: 121062 - DNA, 25 bp, Homo sapien
tttctcttgcgtctgcagtcatgca

SEQ ID NO: 121063 - DNA, 25 bp, Homo sapien
tttctcttggatacagattgctaag

SEQ ID NO: 121064 - DNA, 25 bp, Homo sapien
tttctcttggataccgattgctaag

SEQ ID NO: 121065 - DNA, 25 bp, Homo sapien
tttctcttgtgtctgcagtcatgca

SEQ ID NO: 121066 - DNA, 25 bp, Homo sapien
tttctctttatgaatagcagctgtt

SEQ ID NO: 121067 - DNA, 25 bp, Homo sapien
tttctctttatgagtagcagctgtt

SEQ ID NO: 121068 - DNA, 25 bp, Homo sapien
tttctgaaccaactaacgatggcat

SEQ ID NO: 121069 - DNA, 25 bp, Homo sapien
tttctgaaccagctaacgatggcat

SEQ ID NO: 121070 - DNA, 25 bp, Homo sapien
tttctgaacgcttgcatgattgctt

SEQ ID NO: 121071 - DNA, 25 bp, Homo sapien
tttctgaacgcttgtatgattgctt

SEQ ID NO: 121072 - DNA, 25 bp, Homo sapien
tttctgaacgtgtacaactgaaagc

SEQ ID NO: 121073 - DNA, 25 bp, Homo sapien
tttctgaacgtgtataactgaaagc

SEQ ID NO: 121074 - DNA, 25 bp, Homo sapien
tttctgaacttctgaatgaaataac

SEQ ID NO: 121075 - DNA, 25 bp, Homo sapien
tttctgaacttttgaatgaaataac

SEQ ID NO: 121076 - DNA, 25 bp, Homo sapien
tttctgaagaatgcgttgggccagt

SEQ ID NO: 121077 - DNA, 25 bp, Homo sapien
tttctgaagaatgctttgggccagt

SEQ ID NO: 121078 - DNA, 25 bp, Homo sapien
tttctgaaggactatgaagcttggc

SEQ ID NO: 121079 - DNA, 25 bp, Homo sapien
tttctgaaggactgtgaagcttggc

SEQ ID NO: 121080 - DNA, 25 bp, Homo sapien
tttctgaatccataatggcatgaga

SEQ ID NO: 121081 - DNA, 25 bp, Homo sapien
tttctgaattcataatggcatgaga

SEQ ID NO: 121082 - DNA, 25 bp, Homo sapien
tttctgaatttatagtaacgactca

SEQ ID NO: 121083 - DNA, 25 bp, Homo sapien
tttctgaatttttagtaacgactca

SEQ ID NO: 121084 - DNA, 25 bp, Homo sapien
tttctgaatttttctactgtggaat

SEQ ID NO: 121085 - DNA, 25 bp, Homo sapien
tttctgaatttttgtactgtggaat

SEQ ID NO: 121086 - DNA, 25 bp, Homo sapien
tttctgacacacagtaggtgctcaa

SEQ ID NO: 121087 - DNA, 25 bp, Homo sapien
tttctgacccacagtaggtgctcaa

SEQ ID NO: 121088 - DNA, 25 bp, Homo sapien
tttctgaccttctaattcctttctt

SEQ ID NO: 121089 - DNA, 25 bp, Homo sapien
tttctgaccttctcattcctttctt

SEQ ID NO: 121090 - DNA, 25 bp, Homo sapien
tttctgagaattagatagaccacct

SEQ ID NO: 121091 - DNA, 25 bp, Homo sapien
tttctgagaattatatagaccacct

SEQ ID NO: 121092 - DNA, 25 bp, Homo sapien
tttctgagctccccatagatgaaat

SEQ ID NO: 121093 - DNA, 25 bp, Homo sapien
tttctgagctccccatggatgaaat

SEQ ID NO: 121094 - DNA, 25 bp, Homo sapien
tttctgagtttggtatgatcattag

SEQ ID NO: 121095 - DNA, 25 bp, Homo sapien
tttctgagtttggtgtgatcattag

SEQ ID NO: 121096 - DNA, 25 bp, Homo sapien
tttctgataaaacgaggagactgct

SEQ ID NO: 121097 - DNA, 25 bp, Homo sapien
tttctgataaaaggaggagactgct

SEQ ID NO: 121098 - DNA, 25 bp, Homo sapien
tttctgataatgccccagtttggct

SEQ ID NO: 121099 - DNA, 25 bp, Homo sapien
tttctgataatgccccggtttggct

SEQ ID NO: 121100 - DNA, 25 bp, Homo sapien
tttctgatgactctcataatggcat

SEQ ID NO: 121101 - DNA, 25 bp, Homo sapien
tttctgatggctctcataatggcat

SEQ ID NO: 121102 - DNA, 25 bp, Homo sapien
tttctgattctatcatgagttactc

SEQ ID NO: 121103 - DNA, 25 bp, Homo sapien
tttctgattctatcctgagttactc

SEQ ID NO: 121104 - DNA, 25 bp, Homo sapien
tttctgatttagttgcaagatgtaa

SEQ ID NO: 121105 - DNA, 25 bp, Homo sapien
tttctgatttagtttcaagatgtaa

SEQ ID NO: 121106 - DNA, 25 bp, Homo sapien
tttctgcaataatgtaataatagtt

SEQ ID NO: 121107 - DNA, 25 bp, Homo sapien
tttctgcaatagtgtaataatagtt

SEQ ID NO: 121108 - DNA, 25 bp, Homo sapien
tttctgcacatgtctgagttgtgcg

SEQ ID NO: 121109 - DNA, 25 bp, Homo sapien
tttctgcacgtgtctgagttgtgcg

SEQ ID NO: 121110 - DNA, 25 bp, Homo sapien
tttctgcagttattaaaagttatgt

SEQ ID NO: 121111 - DNA, 25 bp, Homo sapien
tttctgcagttcttaaaagttatgt

SEQ ID NO: 121112 - DNA, 25 bp, Homo sapien
tttctgcatagattcagatgattgg

SEQ ID NO: 121113 - DNA, 25 bp, Homo sapien
tttctgcatggattcagatgattgg

SEQ ID NO: 121114 - DNA, 25 bp, Homo sapien
tttctgcggtaataacaagtctatt

SEQ ID NO: 121115 - DNA, 25 bp, Homo sapien
tttctgcggtaatagcaagtctatt

SEQ ID NO: 121116 - DNA, 25 bp, Homo sapien
tttctgctaccatgaagtccaagaa

SEQ ID NO: 121117 - DNA, 25 bp, Homo sapien
tttctgctaccttgaagtccaagaa

SEQ ID NO: 121118 - DNA, 25 bp, Homo sapien
tttctgctaggtagtaatttctagc

SEQ ID NO: 121119 - DNA, 25 bp, Homo sapien
tttctgctaggtggtaatttctagc

SEQ ID NO: 121120 - DNA, 25 bp, Homo sapien
tttctggccatgtgtctactgccat

SEQ ID NO: 121121 - DNA, 25 bp, Homo sapien
tttctggccgtgtgtctactgccat

SEQ ID NO: 121122 - DNA, 25 bp, Homo sapien
tttctggctcctaccagcctgctca

SEQ ID NO: 121123 - DNA, 25 bp, Homo sapien
tttctggctcctactagcctgctca

SEQ ID NO: 121124 - DNA, 25 bp, Homo sapien
tttctggctctgccgtttctactat

SEQ ID NO: 121125 - DNA, 25 bp, Homo sapien
tttctggctctgtcgtttctactat

SEQ ID NO: 121126 - DNA, 25 bp, Homo sapien
tttctgggcaacttttgtgtgccta

SEQ ID NO: 121127 - DNA, 25 bp, Homo sapien
tttctgggcaatttttgtgtgccta

SEQ ID NO: 121128 - DNA, 25 bp, Homo sapien
tttctgggcactattatatacaata

SEQ ID NO: 121129 - DNA, 25 bp, Homo sapien
tttctgggcgctattatatacaata

SEQ ID NO: 121130 - DNA, 25 bp, Homo sapien
tttctgggtgcattacacttctaca

SEQ ID NO: 121131 - DNA, 25 bp, Homo sapien
tttctgggtgctttacacttctaca

SEQ ID NO: 121132 - DNA, 25 bp, Homo sapien
tttctggtatagggaagagtttgga

SEQ ID NO: 121133 - DNA, 25 bp, Homo sapien
tttctggtccacgtagatttctatg

SEQ ID NO: 121134 - DNA, 25 bp, Homo sapien
tttctggtccacgtggatttctatg

SEQ ID NO: 121135 - DNA, 25 bp, Homo sapien
tttctggtgccctctttacaggatc

SEQ ID NO: 121136 - DNA, 25 bp, Homo sapien
tttctggtgccttctttacaggatc

SEQ ID NO: 121137 - DNA, 25 bp, Homo sapien
tttctggtgtagggaagagtttgga

SEQ ID NO: 121138 - DNA, 25 bp, Homo sapien
tttctggtttcaagcggtgagccta

SEQ ID NO: 121139 - DNA, 25 bp, Homo sapien
tttctggtttcaagtggtgagccta

SEQ ID NO: 121140 - DNA, 25 bp, Homo sapien
tttctggttttgcattgtaaattaa

SEQ ID NO: 121141 - DNA, 25 bp, Homo sapien
tttctggttttgcattttaaattaa

SEQ ID NO: 121142 - DNA, 25 bp, Homo sapien
tttctgtaaaactgcactgatagga

SEQ ID NO: 121143 - DNA, 25 bp, Homo sapien
tttctgtaaaattgcactgatagga

SEQ ID NO: 121144 - DNA, 25 bp, Homo sapien
tttctgtaatgactttcagagtgca

SEQ ID NO: 121145 - DNA, 25 bp, Homo sapien
tttctgtaatgattttcagagtgca

SEQ ID NO: 121146 - DNA, 25 bp, Homo sapien
tttctgtacatcaggaagtataaca

SEQ ID NO: 121147 - DNA, 25 bp, Homo sapien
tttctgtacatcatgaagtataaca

SEQ ID NO: 121148 - DNA, 25 bp, Homo sapien
tttctgtacttgcagttgctagggc

SEQ ID NO: 121149 - DNA, 25 bp, Homo sapien
tttctgtacttggagttgctagggc

SEQ ID NO: 121150 - DNA, 25 bp, Homo sapien
tttctgtagaagctgggctgatgca

SEQ ID NO: 121151 - DNA, 25 bp, Homo sapien
tttctgtagcacaatgcatcttcac

SEQ ID NO: 121152 - DNA, 25 bp, Homo sapien
tttctgtagcataatgcatcttcac

SEQ ID NO: 121153 - DNA, 25 bp, Homo sapien
tttctgtagccagtcatcccaaggc

SEQ ID NO: 121154 - DNA, 25 bp, Homo sapien
tttctgtaggagctgggctgatgca

SEQ ID NO: 121155 - DNA, 25 bp, Homo sapien
tttctgtatccagtcatcccaaggc

SEQ ID NO: 121156 - DNA, 25 bp, Homo sapien
tttctgtcaaagtaggatgagattt

SEQ ID NO: 121157 - DNA, 25 bp, Homo sapien
tttctgtcaaagtgggatgagattt

SEQ ID NO: 121158 - DNA, 25 bp, Homo sapien
tttctgtcaagcagatggtgagggt

SEQ ID NO: 121159 - DNA, 25 bp, Homo sapien
tttctgtcaagtagatggtgagggt

SEQ ID NO: 121160 - DNA, 25 bp, Homo sapien
tttctgtctgtacaacccttttgaa

SEQ ID NO: 121161 - DNA, 25 bp, Homo sapien
tttctgtctgtataacccttttgaa

SEQ ID NO: 121162 - DNA, 25 bp, Homo sapien
tttctgtcttacgtttataccggaa

SEQ ID NO: 121163 - DNA, 25 bp, Homo sapien
tttctgtcttatgtttataccggaa

SEQ ID NO: 121164 - DNA, 25 bp, Homo sapien
tttctgtcttggccccagattttgt

SEQ ID NO: 121165 - DNA, 25 bp, Homo sapien
tttctgtcttggctccagattttgt

SEQ ID NO: 121166 - DNA, 25 bp, Homo sapien
tttctgtgaagacatactgaagtta

SEQ ID NO: 121167 - DNA, 25 bp, Homo sapien
tttctgtgaagtcatactgaagtta

SEQ ID NO: 121168 - DNA, 25 bp, Homo sapien
tttctgtgactattacctgcctgac

SEQ ID NO: 121169 - DNA, 25 bp, Homo sapien
tttctgtgactgttacctgcctgac

SEQ ID NO: 121170 - DNA, 25 bp, Homo sapien
tttctgtgcttggtacatttcattt

SEQ ID NO: 121171 - DNA, 25 bp, Homo sapien
tttctgtgcttggttcatttcattt

SEQ ID NO: 121172 - DNA, 25 bp, Homo sapien
tttctgtggacagactcaagccagc

SEQ ID NO: 121173 - DNA, 25 bp, Homo sapien
tttctgtggacagattcaagccagc

SEQ ID NO: 121174 - DNA, 25 bp, Homo sapien
tttctgtgtatttaaacgtttccat

SEQ ID NO: 121175 - DNA, 25 bp, Homo sapien
tttctgtgtatttaaatgtttccat

SEQ ID NO: 121176 - DNA, 25 bp, Homo sapien
tttctgttaataaaagtctcatcct

SEQ ID NO: 121177 - DNA, 25 bp, Homo sapien
tttctgttaataaaggtctcatcct

SEQ ID NO: 121178 - DNA, 25 bp, Homo sapien
tttctgttacatctatctgtaccta

SEQ ID NO: 121179 - DNA, 25 bp, Homo sapien
tttctgttcaggatttagctaacta

SEQ ID NO: 121180 - DNA, 25 bp, Homo sapien
tttctgttcgggatttagctaacta

SEQ ID NO: 121181 - DNA, 25 bp, Homo sapien
tttctgttgcatctatctgtaccta

SEQ ID NO: 121182 - DNA, 25 bp, Homo sapien
tttctgtttatttaaggctgattgg

SEQ ID NO: 121183 - DNA, 25 bp, Homo sapien
tttctgtttgtttaaggctgattgg

SEQ ID NO: 121184 - DNA, 25 bp, Homo sapien
tttcttaaaagccacgacatagaac

SEQ ID NO: 121185 - DNA, 25 bp, Homo sapien
tttcttaaaagccatgacatagaac

SEQ ID NO: 121186 - DNA, 25 bp, Homo sapien
tttcttaaaatctcattgaatctta

SEQ ID NO: 121187 - DNA, 25 bp, Homo sapien
tttcttaaaatttcattgaatctta

SEQ ID NO: 121188 - DNA, 25 bp, Homo sapien
tttcttaaattgtatgaaggctgag

SEQ ID NO: 121189 - DNA, 25 bp, Homo sapien
tttcttaagttgtatgaaggctgag

SEQ ID NO: 121190 - DNA, 25 bp, Homo sapien
tttcttaatggttcatagttttggt

SEQ ID NO: 121191 - DNA, 25 bp, Homo sapien
tttcttaatggttcattgttttggt

SEQ ID NO: 121192 - DNA, 25 bp, Homo sapien
tttcttacaatagaaccatcctttc

SEQ ID NO: 121193 - DNA, 25 bp, Homo sapien
tttcttacagtagaaccatcctttc

SEQ ID NO: 121194 - DNA, 25 bp, Homo sapien
tttcttacgtagagattagtgctga

SEQ ID NO: 121195 - DNA, 25 bp, Homo sapien
tttcttacgtagggattagtgctga

SEQ ID NO: 121196 - DNA, 25 bp, Homo sapien
tttcttacgttaaacacctaatctt

SEQ ID NO: 121197 - DNA, 25 bp, Homo sapien
tttcttacgttaatcacctaatctt

SEQ ID NO: 121198 - DNA, 25 bp, Homo sapien
tttcttactacaatgtaaatgactg

SEQ ID NO: 121199 - DNA, 25 bp, Homo sapien
tttcttactacagtgtaaatgactg

SEQ ID NO: 121200 - DNA, 25 bp, Homo sapien
tttcttactgggactgtgaaaaaga

SEQ ID NO: 121201 - DNA, 25 bp, Homo sapien
tttcttactggggctgtgaaaaaga

SEQ ID NO: 121202 - DNA, 25 bp, Homo sapien
tttcttagaaaaggatttgtgatct

SEQ ID NO: 121203 - DNA, 25 bp, Homo sapien
tttcttagaaaaggctttgtgatct

SEQ ID NO: 121204 - DNA, 25 bp, Homo sapien
tttcttaggtgttcaggcaaggttg

SEQ ID NO: 121205 - DNA, 25 bp, Homo sapien
tttcttaggtgttgaggcaaggttg

SEQ ID NO: 121206 - DNA, 25 bp, Homo sapien
tttcttattggttttcatagttata

SEQ ID NO: 121207 - DNA, 25 bp, Homo sapien
tttcttatttgttttcatagttata

SEQ ID NO: 121208 - DNA, 25 bp, Homo sapien
tttcttcaaaacctatttcaaaacc

SEQ ID NO: 121209 - DNA, 25 bp, Homo sapien
tttcttcaaaacttatttcaaaacc

SEQ ID NO: 121210 - DNA, 25 bp, Homo sapien
tttcttcaatttcccttggcagtaa

SEQ ID NO: 121211 - DNA, 25 bp, Homo sapien
tttcttcaatttcctttggcagtaa

SEQ ID NO: 121212 - DNA, 25 bp, Homo sapien
tttcttcaccatggggtaacatcta

SEQ ID NO: 121213 - DNA, 25 bp, Homo sapien
tttcttcactatggggtaacatcta

SEQ ID NO: 121214 - DNA, 25 bp, Homo sapien
tttcttcactttccatagaactcta

SEQ ID NO: 121215 - DNA, 25 bp, Homo sapien
tttcttcactttccgtagaactcta

SEQ ID NO: 121216 - DNA, 25 bp, Homo sapien
tttcttcaggacaagcaagacagca

SEQ ID NO: 121217 - DNA, 25 bp, Homo sapien
tttcttcaggacgagcaagacagca

SEQ ID NO: 121218 - DNA, 25 bp, Homo sapien
tttcttcaggttatgtcagtttatt

SEQ ID NO: 121219 - DNA, 25 bp, Homo sapien
tttcttcaggttatgtgagtttatt

SEQ ID NO: 121220 - DNA, 25 bp, Homo sapien
tttcttcatgcatatccacatcagg

SEQ ID NO: 121221 - DNA, 25 bp, Homo sapien
tttcttcatgcatgtccacatcagg

SEQ ID NO: 121222 - DNA, 25 bp, Homo sapien
tttcttcattttgtgagttttctta

SEQ ID NO: 121223 - DNA, 25 bp, Homo sapien
tttcttcattttttgagttttctta

SEQ ID NO: 121224 - DNA, 25 bp, Homo sapien
tttcttccactacaagacactagag

SEQ ID NO: 121225 - DNA, 25 bp, Homo sapien
tttcttccactgcaagacactagag

SEQ ID NO: 121226 - DNA, 25 bp, Homo sapien
tttcttcccaggattcatttccatc

SEQ ID NO: 121227 - DNA, 25 bp, Homo sapien
tttcttcccaggattcgtttccatc

SEQ ID NO: 121228 - DNA, 25 bp, Homo sapien
tttcttcccagttaggagaactatt

SEQ ID NO: 121229 - DNA, 25 bp, Homo sapien
tttcttcccagttatgagaactatt

SEQ ID NO: 121230 - DNA, 25 bp, Homo sapien
tttcttccctggatttcaatttggt

SEQ ID NO: 121231 - DNA, 25 bp, Homo sapien
tttcttccctgggtttcaatttggt

SEQ ID NO: 121232 - DNA, 25 bp, Homo sapien
tttcttcctgccatctttttggaat

SEQ ID NO: 121233 - DNA, 25 bp, Homo sapien
tttcttcctgccgtctttttggaat

SEQ ID NO: 121234 - DNA, 25 bp, Homo sapien
tttcttctcacatggaaggagactt

SEQ ID NO: 121235 - DNA, 25 bp, Homo sapien
tttcttctcacattgaaggagactt

SEQ ID NO: 121236 - DNA, 25 bp, Homo sapien
tttcttctcattaaatctcctgcat

SEQ ID NO: 121237 - DNA, 25 bp, Homo sapien
tttcttctgattaaatctcctgcat

SEQ ID NO: 121238 - DNA, 25 bp, Homo sapien
tttcttctgctgaatcaattctatt

SEQ ID NO: 121239 - DNA, 25 bp, Homo sapien
tttcttctgctggatcaattctatt

SEQ ID NO: 121240 - DNA, 25 bp, Homo sapien
tttcttctgggaaatgctaccctaa

SEQ ID NO: 121241 - DNA, 25 bp, Homo sapien
tttcttctgtgaaatgctaccctaa

SEQ ID NO: 121242 - DNA, 25 bp, Homo sapien
tttcttcttcacttacccgcaagca

SEQ ID NO: 121243 - DNA, 25 bp, Homo sapien
tttcttcttcacttgcccgcaagca

SEQ ID NO: 121244 - DNA, 25 bp, Homo sapien
tttcttcttctcatttctcgccacg

SEQ ID NO: 121245 - DNA, 25 bp, Homo sapien
tttcttcttctgatttctcgccacg

SEQ ID NO: 121246 - DNA, 25 bp, Homo sapien
tttcttgaaataaatagcaagagca

SEQ ID NO: 121247 - DNA, 25 bp, Homo sapien
tttcttgaaatgaatagcaagagca

SEQ ID NO: 121248 - DNA, 25 bp, Homo sapien
tttcttgaatttaatatacttggtg

SEQ ID NO: 121249 - DNA, 25 bp, Homo sapien
tttcttgattcaactattctcctaa

SEQ ID NO: 121250 - DNA, 25 bp, Homo sapien
tttcttgattcacctattctcctaa

SEQ ID NO: 121251 - DNA, 25 bp, Homo sapien
tttcttgattttaatatacttggtg

SEQ ID NO: 121252 - DNA, 25 bp, Homo sapien
tttcttgcatacattctctctgtat

SEQ ID NO: 121253 - DNA, 25 bp, Homo sapien
tttcttgcatacgttctctctgtat

SEQ ID NO: 121254 - DNA, 25 bp, Homo sapien
tttcttgccaaactccattgaattc

SEQ ID NO: 121255 - DNA, 25 bp, Homo sapien
tttcttgccgaactccattgaattc

SEQ ID NO: 121256 - DNA, 25 bp, Homo sapien
tttcttgcctggattatagtaattg

SEQ ID NO: 121257 - DNA, 25 bp, Homo sapien
tttcttgccttgagatatgaggctg

SEQ ID NO: 121258 - DNA, 25 bp, Homo sapien
tttcttgccttgatatatgaggctg

SEQ ID NO: 121259 - DNA, 25 bp, Homo sapien
tttcttgcttggattatagtaattg

SEQ ID NO: 121260 - DNA, 25 bp, Homo sapien
tttcttggaggtagatgccacatgt

SEQ ID NO: 121261 - DNA, 25 bp, Homo sapien
tttcttggcggtagatgccacatgt

SEQ ID NO: 121262 - DNA, 25 bp, Homo sapien
tttcttggtggattagctaaatctg

SEQ ID NO: 121263 - DNA, 25 bp, Homo sapien
tttcttggtggatttgctaaatctg

SEQ ID NO: 121264 - DNA, 25 bp, Homo sapien
tttcttggtgttggtgctggtagca

SEQ ID NO: 121265 - DNA, 25 bp, Homo sapien
tttcttggtgtttgtgctggtagca

SEQ ID NO: 121266 - DNA, 25 bp, Homo sapien
tttcttgtcctgcgacagtgttcag

SEQ ID NO: 121267 - DNA, 25 bp, Homo sapien
tttcttgtcctgtgacagtgttcag

SEQ ID NO: 121268 - DNA, 25 bp, Homo sapien
tttcttgtgacacctaacttttcag

SEQ ID NO: 121269 - DNA, 25 bp, Homo sapien
tttcttgtggcacctaacttttcag

SEQ ID NO: 121270 - DNA, 25 bp, Homo sapien
tttcttgttagtgccatcccgtaag

SEQ ID NO: 121271 - DNA, 25 bp, Homo sapien
tttcttgttagtgtcatcccgtaag

SEQ ID NO: 121272 - DNA, 25 bp, Homo sapien
tttctttattatgaagctaaaacct

SEQ ID NO: 121273 - DNA, 25 bp, Homo sapien
tttctttattatgaggctaaaacct

SEQ ID NO: 121274 - DNA, 25 bp, Homo sapien
tttctttattgaaacggcaactcct

SEQ ID NO: 121275 - DNA, 25 bp, Homo sapien
tttctttattgaaatggcaactcct

SEQ ID NO: 121276 - DNA, 25 bp, Homo sapien
tttctttcaattgtattcctttcct

SEQ ID NO: 121277 - DNA, 25 bp, Homo sapien
tttctttcacctgcatgtttacata

SEQ ID NO: 121278 - DNA, 25 bp, Homo sapien
tttctttcactaagttatcacatgg

SEQ ID NO: 121279 - DNA, 25 bp, Homo sapien
tttctttcatctgcatgtttacata

SEQ ID NO: 121280 - DNA, 25 bp, Homo sapien
tttctttccaagtctgcataagctg

SEQ ID NO: 121281 - DNA, 25 bp, Homo sapien
tttctttccaattctgcataagctg

SEQ ID NO: 121282 - DNA, 25 bp, Homo sapien
tttctttccattgtattcctttcct

SEQ ID NO: 121283 - DNA, 25 bp, Homo sapien
tttctttcgctaagttatcacatgg

SEQ ID NO: 121284 - DNA, 25 bp, Homo sapien
tttctttctctcggctcattaccct

SEQ ID NO: 121285 - DNA, 25 bp, Homo sapien
tttctttctcttggctcattaccct

SEQ ID NO: 121286 - DNA, 25 bp, Homo sapien
tttctttctttcacctgcatgttta

SEQ ID NO: 121287 - DNA, 25 bp, Homo sapien
tttctttctttcatctgcatgttta

SEQ ID NO: 121288 - DNA, 25 bp, Homo sapien
tttctttctttgatggtagagaata

SEQ ID NO: 121289 - DNA, 25 bp, Homo sapien
tttctttctttgccttacattcctt

SEQ ID NO: 121290 - DNA, 25 bp, Homo sapien
tttctttctttggcttacattcctt

SEQ ID NO: 121291 - DNA, 25 bp, Homo sapien
tttctttctttggtggtagagaata

SEQ ID NO: 121292 - DNA, 25 bp, Homo sapien
tttctttgacctatcaattgaggcc

SEQ ID NO: 121293 - DNA, 25 bp, Homo sapien
tttctttgacctatcagttgaggcc

SEQ ID NO: 121294 - DNA, 25 bp, Homo sapien
tttctttgaccttacttacagcagt

SEQ ID NO: 121295 - DNA, 25 bp, Homo sapien
tttctttgagtggcataggaattat

SEQ ID NO: 121296 - DNA, 25 bp, Homo sapien
tttctttgagtggcgtaggaattat

SEQ ID NO: 121297 - DNA, 25 bp, Homo sapien
tttctttgatggtagagaatattgg

SEQ ID NO: 121298 - DNA, 25 bp, Homo sapien
tttctttgatttaacagacaatgta

SEQ ID NO: 121299 - DNA, 25 bp, Homo sapien
tttctttgatttgacagacaatgta

SEQ ID NO: 121300 - DNA, 25 bp, Homo sapien
tttctttgccaaataaggtaacaaa

SEQ ID NO: 121301 - DNA, 25 bp, Homo sapien
tttctttgccaagtaaggtaacaaa

SEQ ID NO: 121302 - DNA, 25 bp, Homo sapien
tttctttgcccttacttacagcagt

SEQ ID NO: 121303 - DNA, 25 bp, Homo sapien
tttctttgccttacattccttattt

SEQ ID NO: 121304 - DNA, 25 bp, Homo sapien
tttctttggcttacattccttattt

SEQ ID NO: 121305 - DNA, 25 bp, Homo sapien
tttctttgggtttcgcgagatactc

SEQ ID NO: 121306 - DNA, 25 bp, Homo sapien
tttctttgggtttcgctagatactc

SEQ ID NO: 121307 - DNA, 25 bp, Homo sapien
tttctttggtggtagagaatattgg

SEQ ID NO: 121308 - DNA, 25 bp, Homo sapien
tttctttgtcacacgaagagagctg

SEQ ID NO: 121309 - DNA, 25 bp, Homo sapien
tttctttgtcacatgaagagagctg

SEQ ID NO: 121310 - DNA, 25 bp, Homo sapien
tttctttgtgtccatccacagatac

SEQ ID NO: 121311 - DNA, 25 bp, Homo sapien
tttctttgtgtctatccacagatac

SEQ ID NO: 121312 - DNA, 25 bp, Homo sapien
tttcttttatacatcataggtagcc

SEQ ID NO: 121313 - DNA, 25 bp, Homo sapien
tttcttttccttgagtaatgaatgc

SEQ ID NO: 121314 - DNA, 25 bp, Homo sapien
tttcttttccttgggtaatgaatgc

SEQ ID NO: 121315 - DNA, 25 bp, Homo sapien
tttcttttgacagcttacagaagcc

SEQ ID NO: 121316 - DNA, 25 bp, Homo sapien
tttcttttgccaacctgcatcttta

SEQ ID NO: 121317 - DNA, 25 bp, Homo sapien
tttcttttgcttcgggcaatatcct

SEQ ID NO: 121318 - DNA, 25 bp, Homo sapien
tttcttttgctttgggcaatatcct

SEQ ID NO: 121319 - DNA, 25 bp, Homo sapien
tttcttttgtacatcataggtagcc

SEQ ID NO: 121320 - DNA, 25 bp, Homo sapien
tttcttttgtcaacctgcatcttta

SEQ ID NO: 121321 - DNA, 25 bp, Homo sapien
tttcttttgtcagcttacagaagcc

SEQ ID NO: 121322 - DNA, 25 bp, Homo sapien
tttcttttttcctatagcaattatc

SEQ ID NO: 121323 - DNA, 25 bp, Homo sapien
tttcttttttcctgtagcaattatc

SEQ ID NO: 121324 - DNA, 25 bp, Homo sapien
tttgaaaatgacgtgctaagtctca

SEQ ID NO: 121325 - DNA, 25 bp, Homo sapien
tttgaaaatgatgtgctaagtctca

SEQ ID NO: 121326 - DNA, 25 bp, Homo sapien
tttgaaaatttcactattttgtcat

SEQ ID NO: 121327 - DNA, 25 bp, Homo sapien
tttgaaaatttccctattttgtcat

SEQ ID NO: 121328 - DNA, 25 bp, Homo sapien
tttgaaaccagaaaactgttgccat

SEQ ID NO: 121329 - DNA, 25 bp, Homo sapien
tttgaaactagaaaactgttgccat

SEQ ID NO: 121330 - DNA, 25 bp, Homo sapien
tttgaaagacaaagtgctaccattt

SEQ ID NO: 121331 - DNA, 25 bp, Homo sapien
tttgaaagacaacgtgctaccattt

SEQ ID NO: 121332 - DNA, 25 bp, Homo sapien
tttgaaagacgctaagaagccacat

SEQ ID NO: 121333 - DNA, 25 bp, Homo sapien
tttgaaagatgctaagaagccacat

SEQ ID NO: 121334 - DNA, 25 bp, Homo sapien
tttgaaagctgtagaaaagtttaca

SEQ ID NO: 121335 - DNA, 25 bp, Homo sapien
tttgaaagctgtataaaagtttaca

SEQ ID NO: 121336 - DNA, 25 bp, Homo sapien
tttgaaagcttagaccttatgggag

SEQ ID NO: 121337 - DNA, 25 bp, Homo sapien
tttgaaagcttataccttatgggag

SEQ ID NO: 121338 - DNA, 25 bp, Homo sapien
tttgaaaggtgcataacggactccc

SEQ ID NO: 121339 - DNA, 25 bp, Homo sapien
tttgaaaggtgcataatggactccc

SEQ ID NO: 121340 - DNA, 25 bp, Homo sapien
tttgaaagtggaaaaggataggctg

SEQ ID NO: 121341 - DNA, 25 bp, Homo sapien
tttgaaagtggaataggataggctg

SEQ ID NO: 121342 - DNA, 25 bp, Homo sapien
tttgaaagtgttcgtgttttttctt

SEQ ID NO: 121343 - DNA, 25 bp, Homo sapien
tttgaaagtgtttgtgttttttctt

SEQ ID NO: 121344 - DNA, 25 bp, Homo sapien
tttgaaatacaagaagtttgtctaa

SEQ ID NO: 121345 - DNA, 25 bp, Homo sapien
tttgaaatataagaagtttgtctaa

SEQ ID NO: 121346 - DNA, 25 bp, Homo sapien
tttgaaatcgggaatacaatgataa

SEQ ID NO: 121347 - DNA, 25 bp, Homo sapien
tttgaaatcggggatacaatgataa

SEQ ID NO: 121348 - DNA, 25 bp, Homo sapien
tttgaaatgctaaataaacactgaa

SEQ ID NO: 121349 - DNA, 25 bp, Homo sapien
tttgaaatggtaaataaacactgaa

SEQ ID NO: 121350 - DNA, 25 bp, Homo sapien
tttgaaattctgctatccaacgaat

SEQ ID NO: 121351 - DNA, 25 bp, Homo sapien
tttgaaattctgctttccaacgaat

SEQ ID NO: 121352 - DNA, 25 bp, Homo sapien
tttgaacaagataagttgagattaa

SEQ ID NO: 121353 - DNA, 25 bp, Homo sapien
tttgaacaagatgagttgagattaa

SEQ ID NO: 121354 - DNA, 25 bp, Homo sapien
tttgaacagaactgacctgtttagc

SEQ ID NO: 121355 - DNA, 25 bp, Homo sapien
tttgaacagcactgacctgtttagc

SEQ ID NO: 121356 - DNA, 25 bp, Homo sapien
tttgaacagcagctgtggaactcag

SEQ ID NO: 121357 - DNA, 25 bp, Homo sapien
tttgaacagcagttgtggaactcag

SEQ ID NO: 121358 - DNA, 25 bp, Homo sapien
tttgaacctaggctgcctggcttca

SEQ ID NO: 121359 - DNA, 25 bp, Homo sapien
tttgaacctaggctgcttggcttca

SEQ ID NO: 121360 - DNA, 25 bp, Homo sapien
tttgaacctatcttgactagagctt

SEQ ID NO: 121361 - DNA, 25 bp, Homo sapien
tttgaacctatcttgagtagagctt

SEQ ID NO: 121362 - DNA, 25 bp, Homo sapien
tttgaactaacataaagaataagaa

SEQ ID NO: 121363 - DNA, 25 bp, Homo sapien
tttgaactgacataaagaataagaa

SEQ ID NO: 121364 - DNA, 25 bp, Homo sapien
tttgaactggacaacgctaaagagg

SEQ ID NO: 121365 - DNA, 25 bp, Homo sapien
tttgaactggacatcgctaaagagg

SEQ ID NO: 121366 - DNA, 25 bp, Homo sapien
tttgaacttggagacttagattact

SEQ ID NO: 121367 - DNA, 25 bp, Homo sapien
tttgaacttggggacttagattact

SEQ ID NO: 121368 - DNA, 25 bp, Homo sapien
tttgaactttggctgcatgttggtg

SEQ ID NO: 121369 - DNA, 25 bp, Homo sapien
tttgaactttggctgcctgttggtg

SEQ ID NO: 121370 - DNA, 25 bp, Homo sapien
tttgaagaaggtattccgctgttta

SEQ ID NO: 121371 - DNA, 25 bp, Homo sapien
tttgaagaaggtattctgctgttta

SEQ ID NO: 121372 - DNA, 25 bp, Homo sapien
tttgaagacttctttttaatcctct

SEQ ID NO: 121373 - DNA, 25 bp, Homo sapien
tttgaagacttgtttttaatcctct

SEQ ID NO: 121374 - DNA, 25 bp, Homo sapien
tttgaagagtttaattttttcctga

SEQ ID NO: 121375 - DNA, 25 bp, Homo sapien
tttgaagagttttattttttcctga

SEQ ID NO: 121376 - DNA, 25 bp, Homo sapien
tttgaagccaaatagaattttttat

SEQ ID NO: 121377 - DNA, 25 bp, Homo sapien
tttgaagccaaatataattttttat

SEQ ID NO: 121378 - DNA, 25 bp, Homo sapien
tttgaagcttgtaacagaaatagga

SEQ ID NO: 121379 - DNA, 25 bp, Homo sapien
tttgaagcttgtaccagaaatagga

SEQ ID NO: 121380 - DNA, 25 bp, Homo sapien
tttgaaggagtcagacaggccgtgg

SEQ ID NO: 121381 - DNA, 25 bp, Homo sapien
tttgaaggcgtcagacaggccgtgg

SEQ ID NO: 121382 - DNA, 25 bp, Homo sapien
tttgaagggtcagtcacgtctcacc

SEQ ID NO: 121383 - DNA, 25 bp, Homo sapien
tttgaaggtggtgctgagaaggatc

SEQ ID NO: 121384 - DNA, 25 bp, Homo sapien
tttgaaggtggttctgagaaggatc

SEQ ID NO: 121385 - DNA, 25 bp, Homo sapien
tttgaaggttcagtcacgtctcacc

SEQ ID NO: 121386 - DNA, 25 bp, Homo sapien
tttgaatagcccgaagtggcggaag

SEQ ID NO: 121387 - DNA, 25 bp, Homo sapien
tttgaatagccggaagtggcggaag

SEQ ID NO: 121388 - DNA, 25 bp, Homo sapien
tttgaatagtatcagacacttttaa

SEQ ID NO: 121389 - DNA, 25 bp, Homo sapien
tttgaatagtattagacacttttaa

SEQ ID NO: 121390 - DNA, 25 bp, Homo sapien
tttgaatagttgccatctttgacat

SEQ ID NO: 121391 - DNA, 25 bp, Homo sapien
tttgaatatgactggtatggtcctc

SEQ ID NO: 121392 - DNA, 25 bp, Homo sapien
tttgaatatgagtggtatggtcctc

SEQ ID NO: 121393 - DNA, 25 bp, Homo sapien
tttgaatatttgccatctttgacat

SEQ ID NO: 121394 - DNA, 25 bp, Homo sapien
tttgaatgcatataaagcacttaat

SEQ ID NO: 121395 - DNA, 25 bp, Homo sapien
tttgaatgcatgtaaagcacttaat

SEQ ID NO: 121396 - DNA, 25 bp, Homo sapien
tttgaatgcatttcggccatgaggt

SEQ ID NO: 121397 - DNA, 25 bp, Homo sapien
tttgaatgcattttggccatgaggt

SEQ ID NO: 121398 - DNA, 25 bp, Homo sapien
tttgaatgtggatcaaaataaggtc

SEQ ID NO: 121399 - DNA, 25 bp, Homo sapien
tttgaatgtgggtcaaaataaggtc

SEQ ID NO: 121400 - DNA, 25 bp, Homo sapien
tttgaattaatacgaaagaggcaaa

SEQ ID NO: 121401 - DNA, 25 bp, Homo sapien
tttgaattaatatgaaagaggcaaa

SEQ ID NO: 121402 - DNA, 25 bp, Homo sapien
tttgaattattccagtccatagaaa

SEQ ID NO: 121403 - DNA, 25 bp, Homo sapien
tttgaattattgcagtccatagaaa

SEQ ID NO: 121404 - DNA, 25 bp, Homo sapien
tttgaattcttccaatatgttaaaa

SEQ ID NO: 121405 - DNA, 25 bp, Homo sapien
tttgaattcttgcaatatgttaaaa

SEQ ID NO: 121406 - DNA, 25 bp, Homo sapien
tttgaatttccctaacattaagcat

SEQ ID NO: 121407 - DNA, 25 bp, Homo sapien
tttgaatttccctaacgttaagcat

SEQ ID NO: 121408 - DNA, 25 bp, Homo sapien
tttgacacagagctacatacacaga

SEQ ID NO: 121409 - DNA, 25 bp, Homo sapien
tttgacacattacctacattactta

SEQ ID NO: 121410 - DNA, 25 bp, Homo sapien
tttgacacattacttacattactta

SEQ ID NO: 121411 - DNA, 25 bp, Homo sapien
tttgacacggagctacatacacaga

SEQ ID NO: 121412 - DNA, 25 bp, Homo sapien
tttgacactgaaatcatatcttgct

SEQ ID NO: 121413 - DNA, 25 bp, Homo sapien
tttgacactgaaatgatatcttgct

SEQ ID NO: 121414 - DNA, 25 bp, Homo sapien
tttgacagacaatcattcagaccac

SEQ ID NO: 121415 - DNA, 25 bp, Homo sapien
tttgacagacagtcattcagaccac

SEQ ID NO: 121416 - DNA, 25 bp, Homo sapien
tttgacagaggacttggacagtgtc

SEQ ID NO: 121417 - DNA, 25 bp, Homo sapien
tttgacagaggtcttggacagtgtc

SEQ ID NO: 121418 - DNA, 25 bp, Homo sapien
tttgacagcaaaacctggcctttcc

SEQ ID NO: 121419 - DNA, 25 bp, Homo sapien
tttgacagcaaaatctggcctttcc

SEQ ID NO: 121420 - DNA, 25 bp, Homo sapien
tttgacagtccatatgtggtgaaaa

SEQ ID NO: 121421 - DNA, 25 bp, Homo sapien
tttgacagttcatatgtggtgaaaa

SEQ ID NO: 121422 - DNA, 25 bp, Homo sapien
tttgacattctaactacaatttcaa

SEQ ID NO: 121423 - DNA, 25 bp, Homo sapien
tttgacattctacctacaatttcaa

SEQ ID NO: 121424 - DNA, 25 bp, Homo sapien
tttgacattggttctcctgtgtgtg

SEQ ID NO: 121425 - DNA, 25 bp, Homo sapien
tttgacattggttttcctgtgtgtg

SEQ ID NO: 121426 - DNA, 25 bp, Homo sapien
tttgacccgtcactggttgaatcca

SEQ ID NO: 121427 - DNA, 25 bp, Homo sapien
tttgacccgtcattggttgaatcca

SEQ ID NO: 121428 - DNA, 25 bp, Homo sapien
tttgacccttgaatggaatttctgg

SEQ ID NO: 121429 - DNA, 25 bp, Homo sapien
tttgacccttgaatggcatttctgg

SEQ ID NO: 121430 - DNA, 25 bp, Homo sapien
tttgaccgccttggcttgtagatgt

SEQ ID NO: 121431 - DNA, 25 bp, Homo sapien
tttgaccgcctttgcttgtagatgt

SEQ ID NO: 121432 - DNA, 25 bp, Homo sapien
tttgacctatcaattgaggccatga

SEQ ID NO: 121433 - DNA, 25 bp, Homo sapien
tttgacctatcagttgaggccatga

SEQ ID NO: 121434 - DNA, 25 bp, Homo sapien
tttgacctgctgttgctgactttga

SEQ ID NO: 121435 - DNA, 25 bp, Homo sapien
tttgacctgttgttgctgactttga

SEQ ID NO: 121436 - DNA, 25 bp, Homo sapien
tttgacgttgaccttcctgccatac

SEQ ID NO: 121437 - DNA, 25 bp, Homo sapien
tttgacgttgatcttcctgccatac

SEQ ID NO: 121438 - DNA, 25 bp, Homo sapien
tttgactaccgtccagagtttctag

SEQ ID NO: 121439 - DNA, 25 bp, Homo sapien
tttgactactgtccagagtttctag

SEQ ID NO: 121440 - DNA, 25 bp, Homo sapien
tttgactgaagagaatgttggaaaa

SEQ ID NO: 121441 - DNA, 25 bp, Homo sapien
tttgactgaagagattgttggaaaa

SEQ ID NO: 121442 - DNA, 25 bp, Homo sapien
tttgactgacatcattaaaaaatta

SEQ ID NO: 121443 - DNA, 25 bp, Homo sapien
tttgactgacatcattgaaaaatta

SEQ ID NO: 121444 - DNA, 25 bp, Homo sapien
tttgactgcaaatcttgccatgttc

SEQ ID NO: 121445 - DNA, 25 bp, Homo sapien
tttgactgcacatcacaccagaaga

SEQ ID NO: 121446 - DNA, 25 bp, Homo sapien
tttgactgcacattacaccagaaga

SEQ ID NO: 121447 - DNA, 25 bp, Homo sapien
tttgactgcctaacttttcagggca

SEQ ID NO: 121448 - DNA, 25 bp, Homo sapien
tttgactgcgaatcttgccatgttc

SEQ ID NO: 121449 - DNA, 25 bp, Homo sapien
tttgactgcttaacttttcagggca

SEQ ID NO: 121450 - DNA, 25 bp, Homo sapien
tttgacttaaaatataccattcatc

SEQ ID NO: 121451 - DNA, 25 bp, Homo sapien
tttgacttaaaatgtaccattcatc

SEQ ID NO: 121452 - DNA, 25 bp, Homo sapien
tttgacttcgcaacagtgcaattat

SEQ ID NO: 121453 - DNA, 25 bp, Homo sapien
tttgacttgctgatgattccatagg

SEQ ID NO: 121454 - DNA, 25 bp, Homo sapien
tttgacttgttgatgattccatagg

SEQ ID NO: 121455 - DNA, 25 bp, Homo sapien
tttgacttgttggcatgttaatttc

SEQ ID NO: 121456 - DNA, 25 bp, Homo sapien
tttgacttgttggtatgttaatttc

SEQ ID NO: 121457 - DNA, 25 bp, Homo sapien
tttgactttcccattgcagtggcta

SEQ ID NO: 121458 - DNA, 25 bp, Homo sapien
tttgactttcccgttgcagtggcta

SEQ ID NO: 121459 - DNA, 25 bp, Homo sapien
tttgactttctagcagtagcatagt

SEQ ID NO: 121460 - DNA, 25 bp, Homo sapien
tttgactttctagtagtagcatagt

SEQ ID NO: 121461 - DNA, 25 bp, Homo sapien
tttgactttgcaacagtgcaattat

SEQ ID NO: 121462 - DNA, 25 bp, Homo sapien
tttgagaagaaatatgtcggcttaa

SEQ ID NO: 121463 - DNA, 25 bp, Homo sapien
tttgagaaggaatatgtcggcttaa

SEQ ID NO: 121464 - DNA, 25 bp, Homo sapien
tttgagaatagttaaaaaattacaa

SEQ ID NO: 121465 - DNA, 25 bp, Homo sapien
tttgagaatagtttaaaaattacaa

SEQ ID NO: 121466 - DNA, 25 bp, Homo sapien
tttgagaccagattgagcaacatag

SEQ ID NO: 121467 - DNA, 25 bp, Homo sapien
tttgagaccgaattttgctcgtctc

SEQ ID NO: 121468 - DNA, 25 bp, Homo sapien
tttgagacctgattgagcaacatag

SEQ ID NO: 121469 - DNA, 25 bp, Homo sapien
tttgagacctgggccactcgggagt

SEQ ID NO: 121470 - DNA, 25 bp, Homo sapien
tttgagactgaattttgctcgtctc

SEQ ID NO: 121471 - DNA, 25 bp, Homo sapien
tttgagacttgggccactcgggagt

SEQ ID NO: 121472 - DNA, 25 bp, Homo sapien
tttgagagacaatcttggaaaactt

SEQ ID NO: 121473 - DNA, 25 bp, Homo sapien
tttgagagagaatcttggaaaactt

SEQ ID NO: 121474 - DNA, 25 bp, Homo sapien
tttgagaggacaataagtacaggca

SEQ ID NO: 121475 - DNA, 25 bp, Homo sapien
tttgagaggacagtaagtacaggca

SEQ ID NO: 121476 - DNA, 25 bp, Homo sapien
tttgagaggtttcactttgtccaac

SEQ ID NO: 121477 - DNA, 25 bp, Homo sapien
tttgagaggtttgactttgtccaac

SEQ ID NO: 121478 - DNA, 25 bp, Homo sapien
tttgagagtaagaaaaaagtaggaa

SEQ ID NO: 121479 - DNA, 25 bp, Homo sapien
tttgagagtaagaagaaagtaggaa

SEQ ID NO: 121480 - DNA, 25 bp, Homo sapien
tttgagatgaaatggttccacctaa

SEQ ID NO: 121481 - DNA, 25 bp, Homo sapien
tttgagatgaagtggttccacctaa

SEQ ID NO: 121482 - DNA, 25 bp, Homo sapien
tttgagatgatgtcactaggattct

SEQ ID NO: 121483 - DNA, 25 bp, Homo sapien
tttgagatgcactcatatttttgca

SEQ ID NO: 121484 - DNA, 25 bp, Homo sapien
tttgagatgcactcatgtttttgca

SEQ ID NO: 121485 - DNA, 25 bp, Homo sapien
tttgagatggtgtcactaggattct

SEQ ID NO: 121486 - DNA, 25 bp, Homo sapien
tttgagattctgattgcggttcttt

SEQ ID NO: 121487 - DNA, 25 bp, Homo sapien
tttgagattctgattgtggttcttt

SEQ ID NO: 121488 - DNA, 25 bp, Homo sapien
tttgagattttatatcatacatagc

SEQ ID NO: 121489 - DNA, 25 bp, Homo sapien
tttgagattttgtatcatacatagc

SEQ ID NO: 121490 - DNA, 25 bp, Homo sapien
tttgagcaagtaaataagtaaaggt

SEQ ID NO: 121491 - DNA, 25 bp, Homo sapien
tttgagcaagtaagtaagtaaaggt

SEQ ID NO: 121492 - DNA, 25 bp, Homo sapien
tttgagcaatacacatgctcatcaa

SEQ ID NO: 121493 - DNA, 25 bp, Homo sapien
tttgagcacgtcattactttctggc

SEQ ID NO: 121494 - DNA, 25 bp, Homo sapien
tttgagcagcactccgccagtgacc

SEQ ID NO: 121495 - DNA, 25 bp, Homo sapien
tttgagcagcactctgccagtgacc

SEQ ID NO: 121496 - DNA, 25 bp, Homo sapien
tttgagcagtacacatgctcatcaa

SEQ ID NO: 121497 - DNA, 25 bp, Homo sapien
tttgagcatcaaggaatacattttc

SEQ ID NO: 121498 - DNA, 25 bp, Homo sapien
tttgagcatcagggaatacattttc

SEQ ID NO: 121499 - DNA, 25 bp, Homo sapien
tttgagcatgtcattactttctggc

SEQ ID NO: 121500 - DNA, 25 bp, Homo sapien
tttgagccaaataaccctttgctgt

SEQ ID NO: 121501 - DNA, 25 bp, Homo sapien
tttgagccagataaccctttgctgt

SEQ ID NO: 121502 - DNA, 25 bp, Homo sapien
tttgagctctttcgcatttatttta

SEQ ID NO: 121503 - DNA, 25 bp, Homo sapien
tttgagctcttttgcatttatttta

SEQ ID NO: 121504 - DNA, 25 bp, Homo sapien
tttgaggatggctgttatccttcta

SEQ ID NO: 121505 - DNA, 25 bp, Homo sapien
tttgaggatgggtgttatccttcta

SEQ ID NO: 121506 - DNA, 25 bp, Homo sapien
tttgaggcctttccagcggtagagt

SEQ ID NO: 121507 - DNA, 25 bp, Homo sapien
tttgaggcctttccagtggtagagt

SEQ ID NO: 121508 - DNA, 25 bp, Homo sapien
tttgaggctgcaaacttctgcaatg

SEQ ID NO: 121509 - DNA, 25 bp, Homo sapien
tttgaggctgcaaatttctgcaatg

SEQ ID NO: 121510 - DNA, 25 bp, Homo sapien
tttgaggttaagaacgagtaataag

SEQ ID NO: 121511 - DNA, 25 bp, Homo sapien
tttgaggttaagaatgagtaataag

SEQ ID NO: 121512 - DNA, 25 bp, Homo sapien
tttgagtacctgatgtaccagcagc

SEQ ID NO: 121513 - DNA, 25 bp, Homo sapien
tttgagtacctgttgtaccagcagc

SEQ ID NO: 121514 - DNA, 25 bp, Homo sapien
tttgagtactacctcagccacagta

SEQ ID NO: 121515 - DNA, 25 bp, Homo sapien
tttgagtactacttcagccacagta

SEQ ID NO: 121516 - DNA, 25 bp, Homo sapien
tttgagtcagagtcttgttctgttg

SEQ ID NO: 121517 - DNA, 25 bp, Homo sapien
tttgagtcagagtctttttctgttg

SEQ ID NO: 121518 - DNA, 25 bp, Homo sapien
tttgagtgaagacataagatctatt

SEQ ID NO: 121519 - DNA, 25 bp, Homo sapien
tttgagtgaagacgtaagatctatt

SEQ ID NO: 121520 - DNA, 25 bp, Homo sapien
tttgagtgactttcgttttcttctt

SEQ ID NO: 121521 - DNA, 25 bp, Homo sapien
tttgagtgacttttgttttcttctt

SEQ ID NO: 121522 - DNA, 25 bp, Homo sapien
tttgagtgcggatgtaaatgatatt

SEQ ID NO: 121523 - DNA, 25 bp, Homo sapien
tttgagtgctgatgtaaatgatatt

SEQ ID NO: 121524 - DNA, 25 bp, Homo sapien
tttgagtggcagcctccatcgtact

SEQ ID NO: 121525 - DNA, 25 bp, Homo sapien
tttgagtggcaggctccatcgtact

SEQ ID NO: 121526 - DNA, 25 bp, Homo sapien
tttgagttactcaactgggagtcgc

SEQ ID NO: 121527 - DNA, 25 bp, Homo sapien
tttgagttactgaactgggagtcgc

SEQ ID NO: 121528 - DNA, 25 bp, Homo sapien
tttgagttcaaacaccaacaagaaa

SEQ ID NO: 121529 - DNA, 25 bp, Homo sapien
tttgagttcaaacgccaacaagaaa

SEQ ID NO: 121530 - DNA, 25 bp, Homo sapien
tttgagttgcatcgaacctgaaatg

SEQ ID NO: 121531 - DNA, 25 bp, Homo sapien
tttgagttgcattgaacctgaaatg

SEQ ID NO: 121532 - DNA, 25 bp, Homo sapien
tttgagttgtttccatattttagct

SEQ ID NO: 121533 - DNA, 25 bp, Homo sapien
tttgagttgttttcatattttagct

SEQ ID NO: 121534 - DNA, 25 bp, Homo sapien
tttgagtttcttaaataggtaggta

SEQ ID NO: 121535 - DNA, 25 bp, Homo sapien
tttgagtttcttaaattggtaggta

SEQ ID NO: 121536 - DNA, 25 bp, Homo sapien
tttgatacttgacttttatattcaa

SEQ ID NO: 121537 - DNA, 25 bp, Homo sapien
tttgatacttgatttttatattcaa

SEQ ID NO: 121538 - DNA, 25 bp, Homo sapien
tttgatatcatgctggcattaacta

SEQ ID NO: 121539 - DNA, 25 bp, Homo sapien
tttgatatcatgttggcattaacta

SEQ ID NO: 121540 - DNA, 25 bp, Homo sapien
tttgatcacatgaaacactttattt

SEQ ID NO: 121541 - DNA, 25 bp, Homo sapien
tttgatcacatgaagcactttattt

SEQ ID NO: 121542 - DNA, 25 bp, Homo sapien
tttgatgaggtggtagagttggatc

SEQ ID NO: 121543 - DNA, 25 bp, Homo sapien
tttgatgaggttgtagagttggatc

SEQ ID NO: 121544 - DNA, 25 bp, Homo sapien
tttgatgatgccaattgctatattg

SEQ ID NO: 121545 - DNA, 25 bp, Homo sapien
tttgatgatgctaattgctatattg

SEQ ID NO: 121546 - DNA, 25 bp, Homo sapien
tttgatgcatcattaaatagagaca

SEQ ID NO: 121547 - DNA, 25 bp, Homo sapien
tttgatgcatcattaagtagagaca

SEQ ID NO: 121548 - DNA, 25 bp, Homo sapien
tttgatgcatttctccataccaaga

SEQ ID NO: 121549 - DNA, 25 bp, Homo sapien
tttgatgcatttctccgtaccaaga

SEQ ID NO: 121550 - DNA, 25 bp, Homo sapien
tttgatgggacatggctgcctagaa

SEQ ID NO: 121551 - DNA, 25 bp, Homo sapien
tttgatgggacttggctgcctagaa

SEQ ID NO: 121552 - DNA, 25 bp, Homo sapien
tttgatgggtagagagcaaaaaatg

SEQ ID NO: 121553 - DNA, 25 bp, Homo sapien
tttgatgggtatagagcaaaaaatg

SEQ ID NO: 121554 - DNA, 25 bp, Homo sapien
tttgattaaatgaccacatgaaaaa

SEQ ID NO: 121555 - DNA, 25 bp, Homo sapien
tttgattaaatggccacatgaaaaa

SEQ ID NO: 121556 - DNA, 25 bp, Homo sapien
tttgattcctttcgcttcctccttt

SEQ ID NO: 121557 - DNA, 25 bp, Homo sapien
tttgattcctttctcttcctccttt

SEQ ID NO: 121558 - DNA, 25 bp, Homo sapien
tttgattgatggctataatggcatt

SEQ ID NO: 121559 - DNA, 25 bp, Homo sapien
tttgattgatgggtataatggcatt

SEQ ID NO: 121560 - DNA, 25 bp, Homo sapien
tttgattgtataatgaatcaacatt

SEQ ID NO: 121561 - DNA, 25 bp, Homo sapien
tttgattgtatagtgaatcaacatt

SEQ ID NO: 121562 - DNA, 25 bp, Homo sapien
tttgattgtattgtcttagatggca

SEQ ID NO: 121563 - DNA, 25 bp, Homo sapien
tttgattgtcacaacttaggagatg

SEQ ID NO: 121564 - DNA, 25 bp, Homo sapien
tttgattgtcacagcttaggagatg

SEQ ID NO: 121565 - DNA, 25 bp, Homo sapien
tttgattgtgttgtcttagatggca

SEQ ID NO: 121566 - DNA, 25 bp, Homo sapien
tttgatttaacagacaatgtataga

SEQ ID NO: 121567 - DNA, 25 bp, Homo sapien
tttgatttcagatttctaacctttg

SEQ ID NO: 121568 - DNA, 25 bp, Homo sapien
tttgatttcagctttctaacctttg

SEQ ID NO: 121569 - DNA, 25 bp, Homo sapien
tttgatttcctaatatgggatggag

SEQ ID NO: 121570 - DNA, 25 bp, Homo sapien
tttgatttcctctttaactcatcag

SEQ ID NO: 121571 - DNA, 25 bp, Homo sapien
tttgatttcgcagtctggctaatta

SEQ ID NO: 121572 - DNA, 25 bp, Homo sapien
tttgatttcttctttaactcatcag

SEQ ID NO: 121573 - DNA, 25 bp, Homo sapien
tttgatttgacagacaatgtataga

SEQ ID NO: 121574 - DNA, 25 bp, Homo sapien
tttgatttgatttttagacggagtt

SEQ ID NO: 121575 - DNA, 25 bp, Homo sapien
tttgatttgctaatatgggatggag

SEQ ID NO: 121576 - DNA, 25 bp, Homo sapien
tttgatttgtaaacttgtggtaatt

SEQ ID NO: 121577 - DNA, 25 bp, Homo sapien
tttgatttgtatacttgtggtaatt

SEQ ID NO: 121578 - DNA, 25 bp, Homo sapien
tttgattttatttttagacggagtt

SEQ ID NO: 121579 - DNA, 25 bp, Homo sapien
tttgattttgcagtctggctaatta

SEQ ID NO: 121580 - DNA, 25 bp, Homo sapien
tttgattttttgtaagactcatctc

SEQ ID NO: 121581 - DNA, 25 bp, Homo sapien
tttgattttttgtgagactcatctc

SEQ ID NO: 121582 - DNA, 25 bp, Homo sapien
tttgatttttttaacgtaagatttc

SEQ ID NO: 121583 - DNA, 25 bp, Homo sapien
tttgatttttttaccgtaagatttc

SEQ ID NO: 121584 - DNA, 25 bp, Homo sapien
tttgcaaaaaaaccacaaagcacct

SEQ ID NO: 121585 - DNA, 25 bp, Homo sapien
tttgcaaaaaaactacaaagcacct

SEQ ID NO: 121586 - DNA, 25 bp, Homo sapien
tttgcaaaacactcacaaataggtt

SEQ ID NO: 121587 - DNA, 25 bp, Homo sapien
tttgcaaaacacttacaaataggtt

SEQ ID NO: 121588 - DNA, 25 bp, Homo sapien
tttgcaaaataaatttggtctcatt

SEQ ID NO: 121589 - DNA, 25 bp, Homo sapien
tttgcaaaataagtttggtctcatt

SEQ ID NO: 121590 - DNA, 25 bp, Homo sapien
tttgcaacataaccacagctgaatt

SEQ ID NO: 121591 - DNA, 25 bp, Homo sapien
tttgcaacataatcacagctgaatt

SEQ ID NO: 121592 - DNA, 25 bp, Homo sapien
tttgcaacatcacgacaaacactac

SEQ ID NO: 121593 - DNA, 25 bp, Homo sapien
tttgcaacatcatgacaaacactac

SEQ ID NO: 121594 - DNA, 25 bp, Homo sapien
tttgcaagaaggcacaatttaatca

SEQ ID NO: 121595 - DNA, 25 bp, Homo sapien
tttgcaagaaggcataatttaatca

SEQ ID NO: 121596 - DNA, 25 bp, Homo sapien
tttgcaaggcatacagacagctgaa

SEQ ID NO: 121597 - DNA, 25 bp, Homo sapien
tttgcaaggcatacaggcagctgaa

SEQ ID NO: 121598 - DNA, 25 bp, Homo sapien
tttgcaatcatctggaatatccaca

SEQ ID NO: 121599 - DNA, 25 bp, Homo sapien
tttgcaatgaatggactggccacaa

SEQ ID NO: 121600 - DNA, 25 bp, Homo sapien
tttgcaatgaatgggctggccacaa

SEQ ID NO: 121601 - DNA, 25 bp, Homo sapien
tttgcaatgtgttgtcattacagga

SEQ ID NO: 121602 - DNA, 25 bp, Homo sapien
tttgcaatgtgttgtcgttacagga

SEQ ID NO: 121603 - DNA, 25 bp, Homo sapien
tttgcaattagccgaacacgtagcc

SEQ ID NO: 121604 - DNA, 25 bp, Homo sapien
tttgcaattagctgaacacgtagcc

SEQ ID NO: 121605 - DNA, 25 bp, Homo sapien
tttgcaattatctggaatatccaca

SEQ ID NO: 121606 - DNA, 25 bp, Homo sapien
tttgcaattctttactctaatccat

SEQ ID NO: 121607 - DNA, 25 bp, Homo sapien
tttgcaattctttgctctaatccat

SEQ ID NO: 121608 - DNA, 25 bp, Homo sapien
tttgcacagttcgaggctcaaaaag

SEQ ID NO: 121609 - DNA, 25 bp, Homo sapien
tttgcacagtttgaggctcaaaaag

SEQ ID NO: 121610 - DNA, 25 bp, Homo sapien
tttgcaccattgttcctgttgttgg

SEQ ID NO: 121611 - DNA, 25 bp, Homo sapien
tttgcaccgttgttcctgttgttgg

SEQ ID NO: 121612 - DNA, 25 bp, Homo sapien
tttgcacctagaagaattagaaaaa

SEQ ID NO: 121613 - DNA, 25 bp, Homo sapien
tttgcacctagaggaattagaaaaa

SEQ ID NO: 121614 - DNA, 25 bp, Homo sapien
tttgcactcggaccgcttcacaggt

SEQ ID NO: 121615 - DNA, 25 bp, Homo sapien
tttgcactcggactgcttcacaggt

SEQ ID NO: 121616 - DNA, 25 bp, Homo sapien
tttgcagactcaaataaatccaaat

SEQ ID NO: 121617 - DNA, 25 bp, Homo sapien
tttgcagactctaaagaggccaccc

SEQ ID NO: 121618 - DNA, 25 bp, Homo sapien
tttgcagactctgaagaggccaccc

SEQ ID NO: 121619 - DNA, 25 bp, Homo sapien
tttgcagagactgcctttccatgtc

SEQ ID NO: 121620 - DNA, 25 bp, Homo sapien
tttgcagaggctgcctttccatgtc

SEQ ID NO: 121621 - DNA, 25 bp, Homo sapien
tttgcagatacaaagctggtttttt

SEQ ID NO: 121622 - DNA, 25 bp, Homo sapien
tttgcagatacaaggctggtttttt

SEQ ID NO: 121623 - DNA, 25 bp, Homo sapien
tttgcagattcaaataaatccaaat

SEQ ID NO: 121624 - DNA, 25 bp, Homo sapien
tttgcagcaaagcctttcccaccat

SEQ ID NO: 121625 - DNA, 25 bp, Homo sapien
tttgcagcaacatggataaacctag

SEQ ID NO: 121626 - DNA, 25 bp, Homo sapien
tttgcagcaacgtggataaacctag

SEQ ID NO: 121627 - DNA, 25 bp, Homo sapien
tttgcagcagagcctttcccaccat

SEQ ID NO: 121628 - DNA, 25 bp, Homo sapien
tttgcagcagtcttcataatgccag

SEQ ID NO: 121629 - DNA, 25 bp, Homo sapien
tttgcagccaagacacccatgagag

SEQ ID NO: 121630 - DNA, 25 bp, Homo sapien
tttgcagccaagacgcccatgagag

SEQ ID NO: 121631 - DNA, 25 bp, Homo sapien
tttgcagcggtcttcataatgccag

SEQ ID NO: 121632 - DNA, 25 bp, Homo sapien
tttgcaggcagagaaaaggagtgtg

SEQ ID NO: 121633 - DNA, 25 bp, Homo sapien
tttgcaggccttaagtatggcagaa

SEQ ID NO: 121634 - DNA, 25 bp, Homo sapien
tttgcaggccttgagtatggcagaa

SEQ ID NO: 121635 - DNA, 25 bp, Homo sapien
tttgcaggtagagaaaaggagtgtg

SEQ ID NO: 121636 - DNA, 25 bp, Homo sapien
tttgcagtattagaacacagacatc

SEQ ID NO: 121637 - DNA, 25 bp, Homo sapien
tttgcagtattaggacacagacatc

SEQ ID NO: 121638 - DNA, 25 bp, Homo sapien
tttgcatacctatagctctttctgt

SEQ ID NO: 121639 - DNA, 25 bp, Homo sapien
tttgcatacttatagctctttctgt

SEQ ID NO: 121640 - DNA, 25 bp, Homo sapien
tttgcatcaaattaacataatgcag

SEQ ID NO: 121641 - DNA, 25 bp, Homo sapien
tttgcatcagattaacataatgcag

SEQ ID NO: 121642 - DNA, 25 bp, Homo sapien
tttgcatcatttcctttgtattatc

SEQ ID NO: 121643 - DNA, 25 bp, Homo sapien
tttgcatcatttcttttgtattatc

SEQ ID NO: 121644 - DNA, 25 bp, Homo sapien
tttgcatctgtgccggcagtttttg

SEQ ID NO: 121645 - DNA, 25 bp, Homo sapien
tttgcatctgtgcctgcagtttttg

SEQ ID NO: 121646 - DNA, 25 bp, Homo sapien
tttgcatggaacagtctcaaacttc

SEQ ID NO: 121647 - DNA, 25 bp, Homo sapien
tttgcatgggacagtctcaaacttc

SEQ ID NO: 121648 - DNA, 25 bp, Homo sapien
tttgcatgtacacaatatgttttct

SEQ ID NO: 121649 - DNA, 25 bp, Homo sapien
tttgcatgtacacattatgttttct

SEQ ID NO: 121650 - DNA, 25 bp, Homo sapien
tttgcattaaaaactaaaaaacaga

SEQ ID NO: 121651 - DNA, 25 bp, Homo sapien
tttgcattaaaaagtaaaaaacaga

SEQ ID NO: 121652 - DNA, 25 bp, Homo sapien
tttgcattaagcattttataaagta

SEQ ID NO: 121653 - DNA, 25 bp, Homo sapien
tttgcattaagcgttttataaagta

SEQ ID NO: 121654 - DNA, 25 bp, Homo sapien
tttgcattcaatatagccatttatg

SEQ ID NO: 121655 - DNA, 25 bp, Homo sapien
tttgcattcaatatcgccatttatg

SEQ ID NO: 121656 - DNA, 25 bp, Homo sapien
tttgcattgtaaattaaagtctatg

SEQ ID NO: 121657 - DNA, 25 bp, Homo sapien
tttgcatttctgtggggtgaatggt

SEQ ID NO: 121658 - DNA, 25 bp, Homo sapien
tttgcatttctgtgggttgaatggt

SEQ ID NO: 121659 - DNA, 25 bp, Homo sapien
tttgcatttgggccgcaaagtaaca

SEQ ID NO: 121660 - DNA, 25 bp, Homo sapien
tttgcatttgggcctcaaagtaaca

SEQ ID NO: 121661 - DNA, 25 bp, Homo sapien
tttgcattttaaattaaagtctatg

SEQ ID NO: 121662 - DNA, 25 bp, Homo sapien
tttgccaaaagcctacatgtgctgt

SEQ ID NO: 121663 - DNA, 25 bp, Homo sapien
tttgccaaaagcctacgtgtgctgt

SEQ ID NO: 121664 - DNA, 25 bp, Homo sapien
tttgccaacatttaagggaggtaga

SEQ ID NO: 121665 - DNA, 25 bp, Homo sapien
tttgccaacgtttaagggaggtaga

SEQ ID NO: 121666 - DNA, 25 bp, Homo sapien
tttgccaagaatatcaggttttatt

SEQ ID NO: 121667 - DNA, 25 bp, Homo sapien
tttgccaagaatatcatgttttatt

SEQ ID NO: 121668 - DNA, 25 bp, Homo sapien
tttgccaagagtaggaaggctcatc

SEQ ID NO: 121669 - DNA, 25 bp, Homo sapien
tttgccaagagtaggatggctcatc

SEQ ID NO: 121670 - DNA, 25 bp, Homo sapien
tttgccaagcgagacagattcaatc

SEQ ID NO: 121671 - DNA, 25 bp, Homo sapien
tttgccaagtgagacagattcaatc

SEQ ID NO: 121672 - DNA, 25 bp, Homo sapien
tttgccagaacataccacaattatt

SEQ ID NO: 121673 - DNA, 25 bp, Homo sapien
tttgccagagcataccacaattatt

SEQ ID NO: 121674 - DNA, 25 bp, Homo sapien
tttgccagcctttttcacttctgcc

SEQ ID NO: 121675 - DNA, 25 bp, Homo sapien
tttgccaggaactgaatgcccatag

SEQ ID NO: 121676 - DNA, 25 bp, Homo sapien
tttgccaggaattgaatgcccatag

SEQ ID NO: 121677 - DNA, 25 bp, Homo sapien
tttgccagtctttttcacttctgcc

SEQ ID NO: 121678 - DNA, 25 bp, Homo sapien
tttgccataatataaggaaaaatga

SEQ ID NO: 121679 - DNA, 25 bp, Homo sapien
tttgccataatctaaggaaaaatga

SEQ ID NO: 121680 - DNA, 25 bp, Homo sapien
tttgccatcaggtagttcatttgtt

SEQ ID NO: 121681 - DNA, 25 bp, Homo sapien
tttgccatgggaatctctttgcctt

SEQ ID NO: 121682 - DNA, 25 bp, Homo sapien
tttgccatgggattctctttgcctt

SEQ ID NO: 121683 - DNA, 25 bp, Homo sapien
tttgccatggtcctggtgtgttacc

SEQ ID NO: 121684 - DNA, 25 bp, Homo sapien
tttgccattaggtagttcatttgtt

SEQ ID NO: 121685 - DNA, 25 bp, Homo sapien
tttgccattgtcctggtgtgttacc

SEQ ID NO: 121686 - DNA, 25 bp, Homo sapien
tttgcccactgtcgatggccaaagg

SEQ ID NO: 121687 - DNA, 25 bp, Homo sapien
tttgcccactgtctatggccaaagg

SEQ ID NO: 121688 - DNA, 25 bp, Homo sapien
tttgcctacatatttggcatgtctg

SEQ ID NO: 121689 - DNA, 25 bp, Homo sapien
tttgcctacatgtttggcatgtctg

SEQ ID NO: 121690 - DNA, 25 bp, Homo sapien
tttgcctacttgacccacattttca

SEQ ID NO: 121691 - DNA, 25 bp, Homo sapien
tttgcctacttgatccacattttca

SEQ ID NO: 121692 - DNA, 25 bp, Homo sapien
tttgcctcagtttatattagtcaag

SEQ ID NO: 121693 - DNA, 25 bp, Homo sapien
tttgcctcatgtctcaaaatcaggt

SEQ ID NO: 121694 - DNA, 25 bp, Homo sapien
tttgcctcatgtctcacaatcaggt

SEQ ID NO: 121695 - DNA, 25 bp, Homo sapien
tttgcctcattttatattagtcaag

SEQ ID NO: 121696 - DNA, 25 bp, Homo sapien
tttgcctctaacatacgtgcatcct

SEQ ID NO: 121697 - DNA, 25 bp, Homo sapien
tttgcctctaacgtacgtgcatcct

SEQ ID NO: 121698 - DNA, 25 bp, Homo sapien
tttgcctctgccgtctcttgctgta

SEQ ID NO: 121699 - DNA, 25 bp, Homo sapien
tttgcctctgctgtctcttgctgta

SEQ ID NO: 121700 - DNA, 25 bp, Homo sapien
tttgcctgactatagtaaccatttc

SEQ ID NO: 121701 - DNA, 25 bp, Homo sapien
tttgcctgactatattaaccatttc

SEQ ID NO: 121702 - DNA, 25 bp, Homo sapien
tttgcctgagatcacgcaattatca

SEQ ID NO: 121703 - DNA, 25 bp, Homo sapien
tttgcctgagatcatgcaattatca

SEQ ID NO: 121704 - DNA, 25 bp, Homo sapien
tttgcctgggaaaaagtcttggaag

SEQ ID NO: 121705 - DNA, 25 bp, Homo sapien
tttgcctgggaagaagtcttggaag

SEQ ID NO: 121706 - DNA, 25 bp, Homo sapien
tttgccttcattattcagtggtttg

SEQ ID NO: 121707 - DNA, 25 bp, Homo sapien
tttgccttcattcttcagtggtttg

SEQ ID NO: 121708 - DNA, 25 bp, Homo sapien
tttgcctttctgtagccagtcatcc

SEQ ID NO: 121709 - DNA, 25 bp, Homo sapien
tttgcctttctgtatccagtcatcc

SEQ ID NO: 121710 - DNA, 25 bp, Homo sapien
tttgctaaaagctctggtctcaaag

SEQ ID NO: 121711 - DNA, 25 bp, Homo sapien
tttgctaaaagctctgttctcaaag

SEQ ID NO: 121712 - DNA, 25 bp, Homo sapien
tttgctaagcacctcggtagatttt

SEQ ID NO: 121713 - DNA, 25 bp, Homo sapien
tttgctaagcgtcaataaacagcat

SEQ ID NO: 121714 - DNA, 25 bp, Homo sapien
tttgctaagcgtcagtaaacagcat

SEQ ID NO: 121715 - DNA, 25 bp, Homo sapien
tttgctaagtacctcggtagatttt

SEQ ID NO: 121716 - DNA, 25 bp, Homo sapien
tttgctaatagtagcggcctacaaa

SEQ ID NO: 121717 - DNA, 25 bp, Homo sapien
tttgctaatagtagtggcctacaaa

SEQ ID NO: 121718 - DNA, 25 bp, Homo sapien
tttgctacttacgatgtgaaagcag

SEQ ID NO: 121719 - DNA, 25 bp, Homo sapien
tttgctacttatgatgtgaaagcag

SEQ ID NO: 121720 - DNA, 25 bp, Homo sapien
tttgctagaagaattgtcttttttt

SEQ ID NO: 121721 - DNA, 25 bp, Homo sapien
tttgctagacgaattgtcttttttt

SEQ ID NO: 121722 - DNA, 25 bp, Homo sapien
tttgctaggtcaccattgagtagga

SEQ ID NO: 121723 - DNA, 25 bp, Homo sapien
tttgctaggtcatcattgagtagga

SEQ ID NO: 121724 - DNA, 25 bp, Homo sapien
tttgctatccactgaattgttacca

SEQ ID NO: 121725 - DNA, 25 bp, Homo sapien
tttgctatccattgaattgttacca

SEQ ID NO: 121726 - DNA, 25 bp, Homo sapien
tttgctcaaagattgtagtttactc

SEQ ID NO: 121727 - DNA, 25 bp, Homo sapien
tttgctcaatgtagtcactttgtct

SEQ ID NO: 121728 - DNA, 25 bp, Homo sapien
tttgctcagagattgtagtttactc

SEQ ID NO: 121729 - DNA, 25 bp, Homo sapien
tttgctcagtgtagtcactttgtct

SEQ ID NO: 121730 - DNA, 25 bp, Homo sapien
tttgctcatcttaaaatctggttgt

SEQ ID NO: 121731 - DNA, 25 bp, Homo sapien
tttgctcattttaaaatctggttgt

SEQ ID NO: 121732 - DNA, 25 bp, Homo sapien
tttgctccacagctactaagcaata

SEQ ID NO: 121733 - DNA, 25 bp, Homo sapien
tttgctccatagctactaagcaata

SEQ ID NO: 121734 - DNA, 25 bp, Homo sapien
tttgctcggtctacatctgatccta

SEQ ID NO: 121735 - DNA, 25 bp, Homo sapien
tttgctcggtctacatgtgatccta

SEQ ID NO: 121736 - DNA, 25 bp, Homo sapien
tttgctcgtctctggttttgagtgt

SEQ ID NO: 121737 - DNA, 25 bp, Homo sapien
tttgctcgtctctgtttttgagtgt

SEQ ID NO: 121738 - DNA, 25 bp, Homo sapien
tttgctctataactggatcattcaa

SEQ ID NO: 121739 - DNA, 25 bp, Homo sapien
tttgctctatacccatcaaattctg

SEQ ID NO: 121740 - DNA, 25 bp, Homo sapien
tttgctctatagccccgacagctgg

SEQ ID NO: 121741 - DNA, 25 bp, Homo sapien
tttgctctatatccccgacagctgg

SEQ ID NO: 121742 - DNA, 25 bp, Homo sapien
tttgctctctacccatcaaattctg

SEQ ID NO: 121743 - DNA, 25 bp, Homo sapien
tttgctcttggagtttttaagataa

SEQ ID NO: 121744 - DNA, 25 bp, Homo sapien
tttgctcttggattttttaagataa

SEQ ID NO: 121745 - DNA, 25 bp, Homo sapien
tttgctctttaactggatcattcaa

SEQ ID NO: 121746 - DNA, 25 bp, Homo sapien
tttgctgaaaacgtgaacttgttaa

SEQ ID NO: 121747 - DNA, 25 bp, Homo sapien
tttgctgaaaatgtgaacttgttaa

SEQ ID NO: 121748 - DNA, 25 bp, Homo sapien
tttgctgaaaattcaggaggggaat

SEQ ID NO: 121749 - DNA, 25 bp, Homo sapien
tttgctgaacattcaggaggggaat

SEQ ID NO: 121750 - DNA, 25 bp, Homo sapien
tttgctgacactgctgcccaccatg

SEQ ID NO: 121751 - DNA, 25 bp, Homo sapien
tttgctgacgctgctgcccaccatg

SEQ ID NO: 121752 - DNA, 25 bp, Homo sapien
tttgctgaggacaagacatgttgac

SEQ ID NO: 121753 - DNA, 25 bp, Homo sapien
tttgctgaggacaagatatgttgac

SEQ ID NO: 121754 - DNA, 25 bp, Homo sapien
tttgctgagtaacacctgcattctc

SEQ ID NO: 121755 - DNA, 25 bp, Homo sapien
tttgctgagtaactcctgcattctc

SEQ ID NO: 121756 - DNA, 25 bp, Homo sapien
tttgctgatggccttgaagcagcct

SEQ ID NO: 121757 - DNA, 25 bp, Homo sapien
tttgctgatggctttgaagcagcct

SEQ ID NO: 121758 - DNA, 25 bp, Homo sapien
tttgctgctatttcagaatttctgt

SEQ ID NO: 121759 - DNA, 25 bp, Homo sapien
tttgctgctatttcggaatttctgt

SEQ ID NO: 121760 - DNA, 25 bp, Homo sapien
tttgctgcttcaacttgttctctgc

SEQ ID NO: 121761 - DNA, 25 bp, Homo sapien
tttgctgcttcatcttgttctctgc

SEQ ID NO: 121762 - DNA, 25 bp, Homo sapien
tttgctggatatgaaattttgggtt

SEQ ID NO: 121763 - DNA, 25 bp, Homo sapien
tttgctggatatggaattttgggtt

SEQ ID NO: 121764 - DNA, 25 bp, Homo sapien
tttgctgtcacactacaagctgcaa

SEQ ID NO: 121765 - DNA, 25 bp, Homo sapien
tttgctgtcacacttcaagctgcaa

SEQ ID NO: 121766 - DNA, 25 bp, Homo sapien
tttgctgtgggacaaatcacaagac

SEQ ID NO: 121767 - DNA, 25 bp, Homo sapien
tttgctgtgggacagatcacaagac

SEQ ID NO: 121768 - DNA, 25 bp, Homo sapien
tttgctgtttcatttatagagcaga

SEQ ID NO: 121769 - DNA, 25 bp, Homo sapien
tttgctgtttcctttatagagcaga

SEQ ID NO: 121770 - DNA, 25 bp, Homo sapien
tttgctgttttaacctactgaggtc

SEQ ID NO: 121771 - DNA, 25 bp, Homo sapien
tttgctgttttaagctactgaggtc

SEQ ID NO: 121772 - DNA, 25 bp, Homo sapien
tttgcttaatcaattctgcttttaa

SEQ ID NO: 121773 - DNA, 25 bp, Homo sapien
tttgcttaatcagttctgcttttaa

SEQ ID NO: 121774 - DNA, 25 bp, Homo sapien
tttgcttacctctcctttacatcat

SEQ ID NO: 121775 - DNA, 25 bp, Homo sapien
tttgcttacctctgctttacatcat

SEQ ID NO: 121776 - DNA, 25 bp, Homo sapien
tttgcttcaccttctgttttcaaat

SEQ ID NO: 121777 - DNA, 25 bp, Homo sapien
tttgcttcgccttctgttttcaaat

SEQ ID NO: 121778 - DNA, 25 bp, Homo sapien
tttgcttctccctgaaaaaaagcaa

SEQ ID NO: 121779 - DNA, 25 bp, Homo sapien
tttgcttctccctgcaaaaaagcaa

SEQ ID NO: 121780 - DNA, 25 bp, Homo sapien
tttgcttgatattcatgaacatttc

SEQ ID NO: 121781 - DNA, 25 bp, Homo sapien
tttgcttgatattcgtgaacatttc

SEQ ID NO: 121782 - DNA, 25 bp, Homo sapien
tttgcttgcttaggattttcatatt

SEQ ID NO: 121783 - DNA, 25 bp, Homo sapien
tttgcttgcttgggattttcatatt

SEQ ID NO: 121784 - DNA, 25 bp, Homo sapien
tttgcttggcctcggaacccaaagg

SEQ ID NO: 121785 - DNA, 25 bp, Homo sapien
tttgcttggccttggaacccaaagg

SEQ ID NO: 121786 - DNA, 25 bp, Homo sapien
tttgcttgtttcttaaatgggttgc

SEQ ID NO: 121787 - DNA, 25 bp, Homo sapien
tttgcttgtttcttaattgggttgc

SEQ ID NO: 121788 - DNA, 25 bp, Homo sapien
tttgctttaatagtaaggtgaaagc

SEQ ID NO: 121789 - DNA, 25 bp, Homo sapien
tttgctttagtagtaaggtgaaagc

SEQ ID NO: 121790 - DNA, 25 bp, Homo sapien
tttgctttatggatgagcttagcat

SEQ ID NO: 121791 - DNA, 25 bp, Homo sapien
tttgctttcaggctgctttgataat

SEQ ID NO: 121792 - DNA, 25 bp, Homo sapien
tttgctttcctgtaccagacacctc

SEQ ID NO: 121793 - DNA, 25 bp, Homo sapien
tttgctttcctttaccagacacctc

SEQ ID NO: 121794 - DNA, 25 bp, Homo sapien
tttgctttcgggctgctttgataat

SEQ ID NO: 121795 - DNA, 25 bp, Homo sapien
tttgctttgcatgctgtgtacgctt

SEQ ID NO: 121796 - DNA, 25 bp, Homo sapien
tttgctttgcatgttgtgtacgctt

SEQ ID NO: 121797 - DNA, 25 bp, Homo sapien
tttgctttgctctctctgcctttaa

SEQ ID NO: 121798 - DNA, 25 bp, Homo sapien
tttgctttgctgtctctgcctttaa

SEQ ID NO: 121799 - DNA, 25 bp, Homo sapien
tttgctttggctgtcttctgtttgt

SEQ ID NO: 121800 - DNA, 25 bp, Homo sapien
tttgctttgtggatgagcttagcat

SEQ ID NO: 121801 - DNA, 25 bp, Homo sapien
tttgcttttcatttgtcagtgaata

SEQ ID NO: 121802 - DNA, 25 bp, Homo sapien
tttgcttttgctgtcttctgtttgt

SEQ ID NO: 121803 - DNA, 25 bp, Homo sapien
tttgctttttatttgtcagtgaata

SEQ ID NO: 121804 - DNA, 25 bp, Homo sapien
tttggaaaaagcagactcgcagcac

SEQ ID NO: 121805 - DNA, 25 bp, Homo sapien
tttggaaaaagcaggctcgcagcac

SEQ ID NO: 121806 - DNA, 25 bp, Homo sapien
tttggaaaaccataaagggctaaac

SEQ ID NO: 121807 - DNA, 25 bp, Homo sapien
tttggaaacactgatggcctatctt

SEQ ID NO: 121808 - DNA, 25 bp, Homo sapien
tttggaaactttaattgatgtaatt

SEQ ID NO: 121809 - DNA, 25 bp, Homo sapien
tttggaaactttagttgatgtaatt

SEQ ID NO: 121810 - DNA, 25 bp, Homo sapien
tttggaaagaactgagccagcccag

SEQ ID NO: 121811 - DNA, 25 bp, Homo sapien
tttggaaagaattgagccagcccag

SEQ ID NO: 121812 - DNA, 25 bp, Homo sapien
tttggaaagccataaagggctaaac

SEQ ID NO: 121813 - DNA, 25 bp, Homo sapien
tttggaaagtgatgtcttgactgga

SEQ ID NO: 121814 - DNA, 25 bp, Homo sapien
tttggaaagtggtgtcttgactgga

SEQ ID NO: 121815 - DNA, 25 bp, Homo sapien
tttggaaatacaaatgctggtttat

SEQ ID NO: 121816 - DNA, 25 bp, Homo sapien
tttggaaatacaaatgttggtttat

SEQ ID NO: 121817 - DNA, 25 bp, Homo sapien
tttggaaatactgatggcctatctt

SEQ ID NO: 121818 - DNA, 25 bp, Homo sapien
tttggaaatctacatgccactgtca

SEQ ID NO: 121819 - DNA, 25 bp, Homo sapien
tttggaaatctacctgccactgtca

SEQ ID NO: 121820 - DNA, 25 bp, Homo sapien
tttggaaattaaatgtctgagaaca

SEQ ID NO: 121821 - DNA, 25 bp, Homo sapien
tttggaaattaagtgtctgagaaca

SEQ ID NO: 121822 - DNA, 25 bp, Homo sapien
tttggaaattggcatgaggagtcta

SEQ ID NO: 121823 - DNA, 25 bp, Homo sapien
tttggaaattggtatgaggagtcta

SEQ ID NO: 121824 - DNA, 25 bp, Homo sapien
tttggaacactgtggaaagccaagg

SEQ ID NO: 121825 - DNA, 25 bp, Homo sapien
tttggaactctgtggaaagccaagg

SEQ ID NO: 121826 - DNA, 25 bp, Homo sapien
tttggaagacaatctgacactttct

SEQ ID NO: 121827 - DNA, 25 bp, Homo sapien
tttggaagacaatttgacactttct

SEQ ID NO: 121828 - DNA, 25 bp, Homo sapien
tttggaaggccatttgacataacaa

SEQ ID NO: 121829 - DNA, 25 bp, Homo sapien
tttggaaggccatttggcataacaa

SEQ ID NO: 121830 - DNA, 25 bp, Homo sapien
tttggaagtcacagaatgtcatttc

SEQ ID NO: 121831 - DNA, 25 bp, Homo sapien
tttggaagtcacataatgtcatttc

SEQ ID NO: 121832 - DNA, 25 bp, Homo sapien
tttggaatacaataaaatgcttgca

SEQ ID NO: 121833 - DNA, 25 bp, Homo sapien
tttggaatacaatagaatgcttgca

SEQ ID NO: 121834 - DNA, 25 bp, Homo sapien
tttggaatcaagatagtttgggatt

SEQ ID NO: 121835 - DNA, 25 bp, Homo sapien
tttggaatcctcatgccactgaagc

SEQ ID NO: 121836 - DNA, 25 bp, Homo sapien
tttggaatcctcatgctactgaagc

SEQ ID NO: 121837 - DNA, 25 bp, Homo sapien
tttggaatcgagatagtttgggatt

SEQ ID NO: 121838 - DNA, 25 bp, Homo sapien
tttggacacaacagaagaaataatc

SEQ ID NO: 121839 - DNA, 25 bp, Homo sapien
tttggacacaatagaagaaataatc

SEQ ID NO: 121840 - DNA, 25 bp, Homo sapien
tttggacagggtcgtgtgatggttt

SEQ ID NO: 121841 - DNA, 25 bp, Homo sapien
tttggacagggttgtgtgatggttt

SEQ ID NO: 121842 - DNA, 25 bp, Homo sapien
tttggacatatccttactgttcata

SEQ ID NO: 121843 - DNA, 25 bp, Homo sapien
tttggacatgtccttactgttcata

SEQ ID NO: 121844 - DNA, 25 bp, Homo sapien
tttggacatttcccgttaggaacca

SEQ ID NO: 121845 - DNA, 25 bp, Homo sapien
tttggacatttccctttaggaacca

SEQ ID NO: 121846 - DNA, 25 bp, Homo sapien
tttggaccatcaatgctttcctaat

SEQ ID NO: 121847 - DNA, 25 bp, Homo sapien
tttggaccatcagtgctttcctaat

SEQ ID NO: 121848 - DNA, 25 bp, Homo sapien
tttggactcagggtttatactagcg

SEQ ID NO: 121849 - DNA, 25 bp, Homo sapien
tttggactcaggttttatactagcg

SEQ ID NO: 121850 - DNA, 25 bp, Homo sapien
tttggactttatacaggaaataatt

SEQ ID NO: 121851 - DNA, 25 bp, Homo sapien
tttggactttatagaggaaataatt

SEQ ID NO: 121852 - DNA, 25 bp, Homo sapien
tttggagaaatttacttgccttaaa

SEQ ID NO: 121853 - DNA, 25 bp, Homo sapien
tttggagaatgcaaaaaaatcaaaa

SEQ ID NO: 121854 - DNA, 25 bp, Homo sapien
tttggagaatgcagaaaaatcaaaa

SEQ ID NO: 121855 - DNA, 25 bp, Homo sapien
tttggagaattttacttgccttaaa

SEQ ID NO: 121856 - DNA, 25 bp, Homo sapien
tttggagaggtataaaatgaggtct

SEQ ID NO: 121857 - DNA, 25 bp, Homo sapien
tttggagagttataaaatgaggtct

SEQ ID NO: 121858 - DNA, 25 bp, Homo sapien
tttggagatagagcctttcaagaaa

SEQ ID NO: 121859 - DNA, 25 bp, Homo sapien
tttggagatagaggctttcaagaaa

SEQ ID NO: 121860 - DNA, 25 bp, Homo sapien
tttggagatttagaaactgtaggat

SEQ ID NO: 121861 - DNA, 25 bp, Homo sapien
tttggagatttagaaagtgtaggat

SEQ ID NO: 121862 - DNA, 25 bp, Homo sapien
tttggagcccataggaggaagttcc

SEQ ID NO: 121863 - DNA, 25 bp, Homo sapien
tttggagcccatagtaggaagttcc

SEQ ID NO: 121864 - DNA, 25 bp, Homo sapien
tttggagtacaaacgatcccatcat

SEQ ID NO: 121865 - DNA, 25 bp, Homo sapien
tttggagtagaaacgatcccatcat

SEQ ID NO: 121866 - DNA, 25 bp, Homo sapien
tttggagtcatgcaaccaattcact

SEQ ID NO: 121867 - DNA, 25 bp, Homo sapien
tttggagtcgtgcaaccaattcact

SEQ ID NO: 121868 - DNA, 25 bp, Homo sapien
tttggagtgtggactgttcggttaa

SEQ ID NO: 121869 - DNA, 25 bp, Homo sapien
tttggagtgtgtactgttcggttaa

SEQ ID NO: 121870 - DNA, 25 bp, Homo sapien
tttggatactttttccagttgattc

SEQ ID NO: 121871 - DNA, 25 bp, Homo sapien
tttggatacttttttcagttgattc

SEQ ID NO: 121872 - DNA, 25 bp, Homo sapien
tttggataggtaaatagagtttgca

SEQ ID NO: 121873 - DNA, 25 bp, Homo sapien
tttggataggtaaatatagtttgca

SEQ ID NO: 121874 - DNA, 25 bp, Homo sapien
tttggatatgcctcacagttgcatt

SEQ ID NO: 121875 - DNA, 25 bp, Homo sapien
tttggatatgcctcgcagttgcatt

SEQ ID NO: 121876 - DNA, 25 bp, Homo sapien
tttggatatttggattccagtcctt

SEQ ID NO: 121877 - DNA, 25 bp, Homo sapien
tttggatatttgggttccagtcctt

SEQ ID NO: 121878 - DNA, 25 bp, Homo sapien
tttggatcaaccctcagaacacaca

SEQ ID NO: 121879 - DNA, 25 bp, Homo sapien
tttggatcaactctcagaacacaca

SEQ ID NO: 121880 - DNA, 25 bp, Homo sapien
tttggatcgggcagccattgtgcac

SEQ ID NO: 121881 - DNA, 25 bp, Homo sapien
tttggatcgggcagccgttgtgcac

SEQ ID NO: 121882 - DNA, 25 bp, Homo sapien
tttggatgaagcccagcaaattcct

SEQ ID NO: 121883 - DNA, 25 bp, Homo sapien
tttggatgaagcgcagcaaattcct

SEQ ID NO: 121884 - DNA, 25 bp, Homo sapien
tttggatgtatttatacggcaccct

SEQ ID NO: 121885 - DNA, 25 bp, Homo sapien
tttggatgtatttatatggcaccct

SEQ ID NO: 121886 - DNA, 25 bp, Homo sapien
tttggattaaagaatcgcaaacgcc

SEQ ID NO: 121887 - DNA, 25 bp, Homo sapien
tttggattaaagacaattcatgcct

SEQ ID NO: 121888 - DNA, 25 bp, Homo sapien
tttggattaaaggcaattcatgcct

SEQ ID NO: 121889 - DNA, 25 bp, Homo sapien
tttggattagagaatcgcaaacgcc

SEQ ID NO: 121890 - DNA, 25 bp, Homo sapien
tttggattgtatcttagacattgtg

SEQ ID NO: 121891 - DNA, 25 bp, Homo sapien
tttggattgtatgttagacattgtg

SEQ ID NO: 121892 - DNA, 25 bp, Homo sapien
tttggatttgtgaaagatggctata

SEQ ID NO: 121893 - DNA, 25 bp, Homo sapien
tttggatttgtgaacgatggctata

SEQ ID NO: 121894 - DNA, 25 bp, Homo sapien
tttggcaaatactgagggcagggcc

SEQ ID NO: 121895 - DNA, 25 bp, Homo sapien
tttggcaaatacttagggcagggcc

SEQ ID NO: 121896 - DNA, 25 bp, Homo sapien
tttggcaattcctaataaagcaaca

SEQ ID NO: 121897 - DNA, 25 bp, Homo sapien
tttggcaattcctattaaagcaaca

SEQ ID NO: 121898 - DNA, 25 bp, Homo sapien
tttggcaccaaggccagggagcctc

SEQ ID NO: 121899 - DNA, 25 bp, Homo sapien
tttggcactaaggccagggagcctc

SEQ ID NO: 121900 - DNA, 25 bp, Homo sapien
tttggcacttgctgttcctccagcc

SEQ ID NO: 121901 - DNA, 25 bp, Homo sapien
tttggcacttgttgttcctccagcc

SEQ ID NO: 121902 - DNA, 25 bp, Homo sapien
tttggcagtctcgttctctataaaa

SEQ ID NO: 121903 - DNA, 25 bp, Homo sapien
tttggcagtcttgttctctataaaa

SEQ ID NO: 121904 - DNA, 25 bp, Homo sapien
tttggcagttaccctttgtcaagtt

SEQ ID NO: 121905 - DNA, 25 bp, Homo sapien
tttggcagttactctttgtcaagtt

SEQ ID NO: 121906 - DNA, 25 bp, Homo sapien
tttggcatcatacaataagtgacaa

SEQ ID NO: 121907 - DNA, 25 bp, Homo sapien
tttggcatcatataataagtgacaa

SEQ ID NO: 121908 - DNA, 25 bp, Homo sapien
tttggcatttgcttcaaacagcctg

SEQ ID NO: 121909 - DNA, 25 bp, Homo sapien
tttggcatttgtttcaaacagcctg

SEQ ID NO: 121910 - DNA, 25 bp, Homo sapien
tttggccatcactcgggaaaatcca

SEQ ID NO: 121911 - DNA, 25 bp, Homo sapien
tttggccatcattcgggaaaatcca

SEQ ID NO: 121912 - DNA, 25 bp, Homo sapien
tttggccatggagataaatttgcaa

SEQ ID NO: 121913 - DNA, 25 bp, Homo sapien
tttggccatggagatacatttgcaa

SEQ ID NO: 121914 - DNA, 25 bp, Homo sapien
tttggccattatggtattgtccagt

SEQ ID NO: 121915 - DNA, 25 bp, Homo sapien
tttggccattatgttattgtccagt

SEQ ID NO: 121916 - DNA, 25 bp, Homo sapien
tttggccgtccatggtggcagtcag

SEQ ID NO: 121917 - DNA, 25 bp, Homo sapien
tttggccgtccgtggtggcagtcag

SEQ ID NO: 121918 - DNA, 25 bp, Homo sapien
tttggcctatccaccacattccata

SEQ ID NO: 121919 - DNA, 25 bp, Homo sapien
tttggcctatccaccatattccata

SEQ ID NO: 121920 - DNA, 25 bp, Homo sapien
tttggccttattgatacattttgac

SEQ ID NO: 121921 - DNA, 25 bp, Homo sapien
tttggccttattgatagattttgac

SEQ ID NO: 121922 - DNA, 25 bp, Homo sapien
tttggctcttggccgtagaagagca

SEQ ID NO: 121923 - DNA, 25 bp, Homo sapien
tttggctcttggctgtagaagagca

SEQ ID NO: 121924 - DNA, 25 bp, Homo sapien
tttggctgcactttgaaggtaggaa

SEQ ID NO: 121925 - DNA, 25 bp, Homo sapien
tttggctgccacttgcttataaata

SEQ ID NO: 121926 - DNA, 25 bp, Homo sapien
tttggctgccagttgcttataaata

SEQ ID NO: 121927 - DNA, 25 bp, Homo sapien
tttggctgcgctttgaaggtaggaa

SEQ ID NO: 121928 - DNA, 25 bp, Homo sapien
tttggctgtaaatatatagcaattt

SEQ ID NO: 121929 - DNA, 25 bp, Homo sapien
tttggctgtaagtatatagcaattt

SEQ ID NO: 121930 - DNA, 25 bp, Homo sapien
tttggctgtcagtgaagcggaagca

SEQ ID NO: 121931 - DNA, 25 bp, Homo sapien
tttggctgttagtgaagcggaagca

SEQ ID NO: 121932 - DNA, 25 bp, Homo sapien
tttggcttaagcatatatatgactc

SEQ ID NO: 121933 - DNA, 25 bp, Homo sapien
tttggcttaagcgtatatatgactc

SEQ ID NO: 121934 - DNA, 25 bp, Homo sapien
tttggcttcaataattccattttat

SEQ ID NO: 121935 - DNA, 25 bp, Homo sapien
tttggcttcaattcgacggttagtt

SEQ ID NO: 121936 - DNA, 25 bp, Homo sapien
tttggcttcaattcgatggttagtt

SEQ ID NO: 121937 - DNA, 25 bp, Homo sapien
tttggctttaataattccattttat

SEQ ID NO: 121938 - DNA, 25 bp, Homo sapien
tttggctttcattacacagtagctc

SEQ ID NO: 121939 - DNA, 25 bp, Homo sapien
tttggctttcattgcacagtagctc

SEQ ID NO: 121940 - DNA, 25 bp, Homo sapien
tttggctttttttggtccaactcta

SEQ ID NO: 121941 - DNA, 25 bp, Homo sapien
tttggcttttttttgtccaactcta

SEQ ID NO: 121942 - DNA, 25 bp, Homo sapien
tttgggaaacaaacaacttgccatg

SEQ ID NO: 121943 - DNA, 25 bp, Homo sapien
tttgggaaacaaccaacttgccatg

SEQ ID NO: 121944 - DNA, 25 bp, Homo sapien
tttgggaacaactctttggcagggc

SEQ ID NO: 121945 - DNA, 25 bp, Homo sapien
tttgggaacaattctttggcagggc

SEQ ID NO: 121946 - DNA, 25 bp, Homo sapien
tttgggaaggtcagttaagagaaga

SEQ ID NO: 121947 - DNA, 25 bp, Homo sapien
tttgggaaggtcagttgagagaaga

SEQ ID NO: 121948 - DNA, 25 bp, Homo sapien
tttgggacactgttctttccaccta

SEQ ID NO: 121949 - DNA, 25 bp, Homo sapien
tttgggacattgttctttccaccta

SEQ ID NO: 121950 - DNA, 25 bp, Homo sapien
tttgggagacctaacaggttttgaa

SEQ ID NO: 121951 - DNA, 25 bp, Homo sapien
tttgggagacctgacaggttttgaa

SEQ ID NO: 121952 - DNA, 25 bp, Homo sapien
tttgggaggaaagagagtaatgacg

SEQ ID NO: 121953 - DNA, 25 bp, Homo sapien
tttgggaggaaagatagtaatgacg

SEQ ID NO: 121954 - DNA, 25 bp, Homo sapien
tttgggaggaggcttcttattcatg

SEQ ID NO: 121955 - DNA, 25 bp, Homo sapien
tttgggaggagggttcttattcatg

SEQ ID NO: 121956 - DNA, 25 bp, Homo sapien
tttgggaggtaatgcaagaaaacag

SEQ ID NO: 121957 - DNA, 25 bp, Homo sapien
tttgggaggtagtgcaagaaaacag

SEQ ID NO: 121958 - DNA, 25 bp, Homo sapien
tttgggatttggtagacagataact

SEQ ID NO: 121959 - DNA, 25 bp, Homo sapien
tttgggatttggtagatagataact

SEQ ID NO: 121960 - DNA, 25 bp, Homo sapien
tttgggcaaatagcctaccctttct

SEQ ID NO: 121961 - DNA, 25 bp, Homo sapien
tttgggcaaatagcttaccctttct

SEQ ID NO: 121962 - DNA, 25 bp, Homo sapien
tttgggcaagtttactccgagcctt

SEQ ID NO: 121963 - DNA, 25 bp, Homo sapien
tttgggcaggacttgtttattgtta

SEQ ID NO: 121964 - DNA, 25 bp, Homo sapien
tttgggcaggtttactccgagcctt

SEQ ID NO: 121965 - DNA, 25 bp, Homo sapien
tttgggcagtacttgtttattgtta

SEQ ID NO: 121966 - DNA, 25 bp, Homo sapien
tttgggcatatgctttattatgtat

SEQ ID NO: 121967 - DNA, 25 bp, Homo sapien
tttgggcatatgctttgttatgtat

SEQ ID NO: 121968 - DNA, 25 bp, Homo sapien
tttgggccgcaaagtaacaacaaca

SEQ ID NO: 121969 - DNA, 25 bp, Homo sapien
tttgggcctcaaagtaacaacaaca

SEQ ID NO: 121970 - DNA, 25 bp, Homo sapien
tttgggctccttctggctccaagtc

SEQ ID NO: 121971 - DNA, 25 bp, Homo sapien
tttgggcttcgaacgtaactgacat

SEQ ID NO: 121972 - DNA, 25 bp, Homo sapien
tttgggcttcgaatgtaactgacat

SEQ ID NO: 121973 - DNA, 25 bp, Homo sapien
tttgggcttcttctggctccaagtc

SEQ ID NO: 121974 - DNA, 25 bp, Homo sapien
tttgggctttccaggtctgccttct

SEQ ID NO: 121975 - DNA, 25 bp, Homo sapien
tttgggctttccatgtctgccttct

SEQ ID NO: 121976 - DNA, 25 bp, Homo sapien
tttggggaaattagtttgattttct

SEQ ID NO: 121977 - DNA, 25 bp, Homo sapien
tttggggaaattattttgattttct

SEQ ID NO: 121978 - DNA, 25 bp, Homo sapien
tttggggctgcacctaacttctgcc

SEQ ID NO: 121979 - DNA, 25 bp, Homo sapien
tttggggctgcatctaacttctgcc

SEQ ID NO: 121980 - DNA, 25 bp, Homo sapien
tttgggtcatggtgttttagtcttt

SEQ ID NO: 121981 - DNA, 25 bp, Homo sapien
tttgggtcatggttttttagtcttt

SEQ ID NO: 121982 - DNA, 25 bp, Homo sapien
tttgggtcattctgtcaggtaaaat

SEQ ID NO: 121983 - DNA, 25 bp, Homo sapien
tttgggtcctctatagcacttacta

SEQ ID NO: 121984 - DNA, 25 bp, Homo sapien
tttgggtcctctgtagcacttacta

SEQ ID NO: 121985 - DNA, 25 bp, Homo sapien
tttgggtcgttctgtcaggtaaaat

SEQ ID NO: 121986 - DNA, 25 bp, Homo sapien
tttgggtttcgcgagatactctctc

SEQ ID NO: 121987 - DNA, 25 bp, Homo sapien
tttgggtttcgctagatactctctc

SEQ ID NO: 121988 - DNA, 25 bp, Homo sapien
tttggtatagaagtatctgaatttt

SEQ ID NO: 121989 - DNA, 25 bp, Homo sapien
tttggtatagaagtatttgaatttt

SEQ ID NO: 121990 - DNA, 25 bp, Homo sapien
tttggtattgtcaggacttggattc

SEQ ID NO: 121991 - DNA, 25 bp, Homo sapien
tttggtattgtcaggatttggattc

SEQ ID NO: 121992 - DNA, 25 bp, Homo sapien
tttggtcttagggaaataaatcatt

SEQ ID NO: 121993 - DNA, 25 bp, Homo sapien
tttggtcttaggtaaataaatcatt

SEQ ID NO: 121994 - DNA, 25 bp, Homo sapien
tttggtcttcggcctcctgcttcca

SEQ ID NO: 121995 - DNA, 25 bp, Homo sapien
tttggtctttggcctcctgcttcca

SEQ ID NO: 121996 - DNA, 25 bp, Homo sapien
tttggtgaactggtggacctacaag

SEQ ID NO: 121997 - DNA, 25 bp, Homo sapien
tttggtgaactggtggccctacaag

SEQ ID NO: 121998 - DNA, 25 bp, Homo sapien
tttggtgacatttgttatgcagaag

SEQ ID NO: 121999 - DNA, 25 bp, Homo sapien
tttggtgaccttaagtgagttgctc

SEQ ID NO: 122000 - DNA, 25 bp, Homo sapien
tttggtgaccttaattgagttgctc

SEQ ID NO: 122001 - DNA, 25 bp, Homo sapien
tttggtgacggcacaaatttccttg

SEQ ID NO: 122002 - DNA, 25 bp, Homo sapien
tttggtgacggcaccaatttccttg

SEQ ID NO: 122003 - DNA, 25 bp, Homo sapien
tttggtgatatttgttatgcagaag

SEQ ID NO: 122004 - DNA, 25 bp, Homo sapien
tttggtgcaatcaaaggaatgtgaa

SEQ ID NO: 122005 - DNA, 25 bp, Homo sapien
tttggtgcaattaaaggaatgtgaa

SEQ ID NO: 122006 - DNA, 25 bp, Homo sapien
tttggtgccaggaaccaaaccaagg

SEQ ID NO: 122007 - DNA, 25 bp, Homo sapien
tttggtgccaggatccaaaccaagg

SEQ ID NO: 122008 - DNA, 25 bp, Homo sapien
tttggtgctccactctagtatatgt

SEQ ID NO: 122009 - DNA, 25 bp, Homo sapien
tttggtgctccgctctagtatatgt

SEQ ID NO: 122010 - DNA, 25 bp, Homo sapien
tttggtgctctaagaaccaagaaaa

SEQ ID NO: 122011 - DNA, 25 bp, Homo sapien
tttggtgctgtaagaaccaagaaaa

SEQ ID NO: 122012 - DNA, 25 bp, Homo sapien
tttggtggaaacattgctaacactg

SEQ ID NO: 122013 - DNA, 25 bp, Homo sapien
tttggtggaaacgttgctaacactg

SEQ ID NO: 122014 - DNA, 25 bp, Homo sapien
tttggtgtacagaatattttaccac

SEQ ID NO: 122015 - DNA, 25 bp, Homo sapien
tttggtgtacagattattttaccac

SEQ ID NO: 122016 - DNA, 25 bp, Homo sapien
tttggtgtcctgttgtaactttagt

SEQ ID NO: 122017 - DNA, 25 bp, Homo sapien
tttggtgtcctgttttaactttagt

SEQ ID NO: 122018 - DNA, 25 bp, Homo sapien
tttggttaacgtactcttatattct

SEQ ID NO: 122019 - DNA, 25 bp, Homo sapien
tttggttaatgtactcttatattct

SEQ ID NO: 122020 - DNA, 25 bp, Homo sapien
tttggttattttctcatggcatgac

SEQ ID NO: 122021 - DNA, 25 bp, Homo sapien
tttggttattttttcatggcatgac

SEQ ID NO: 122022 - DNA, 25 bp, Homo sapien
tttggttcacttcgctactactgaa

SEQ ID NO: 122023 - DNA, 25 bp, Homo sapien
tttggttcactttgctactactgaa

SEQ ID NO: 122024 - DNA, 25 bp, Homo sapien
tttggttctctatgtctgcactgca

SEQ ID NO: 122025 - DNA, 25 bp, Homo sapien
tttggttctctgtgtctgcactgca

SEQ ID NO: 122026 - DNA, 25 bp, Homo sapien
tttggttgagtgaaaccatgaataa

SEQ ID NO: 122027 - DNA, 25 bp, Homo sapien
tttggttgagtgaaactatgaataa

SEQ ID NO: 122028 - DNA, 25 bp, Homo sapien
tttggtttatggagacctggctaag

SEQ ID NO: 122029 - DNA, 25 bp, Homo sapien
tttggtttatggagccctggctaag

SEQ ID NO: 122030 - DNA, 25 bp, Homo sapien
tttggtttcaagaacattgaatgct

SEQ ID NO: 122031 - DNA, 25 bp, Homo sapien
tttggtttcaagaccattgaatgct

SEQ ID NO: 122032 - DNA, 25 bp, Homo sapien
tttggtttctcttctacgactaatc

SEQ ID NO: 122033 - DNA, 25 bp, Homo sapien
tttggtttctcttctatgactaatc

SEQ ID NO: 122034 - DNA, 25 bp, Homo sapien
tttggtttttttattgcccagacca

SEQ ID NO: 122035 - DNA, 25 bp, Homo sapien
tttggtttttttgttgcccagacca

SEQ ID NO: 122036 - DNA, 25 bp, Homo sapien
tttgtaaaaataggtcattcttaaa

SEQ ID NO: 122037 - DNA, 25 bp, Homo sapien
tttgtaaaagtaggtcattcttaaa

SEQ ID NO: 122038 - DNA, 25 bp, Homo sapien
tttgtaaacatatgccctgcagtaa

SEQ ID NO: 122039 - DNA, 25 bp, Homo sapien
tttgtaaacatatgtcctgcagtaa

SEQ ID NO: 122040 - DNA, 25 bp, Homo sapien
tttgtaaaccgtacgccttgaccag

SEQ ID NO: 122041 - DNA, 25 bp, Homo sapien
tttgtaaaccgtgcgccttgaccag

SEQ ID NO: 122042 - DNA, 25 bp, Homo sapien
tttgtaaagccttgaacaagaaagc

SEQ ID NO: 122043 - DNA, 25 bp, Homo sapien
tttgtaaagccttgaagaagaaagc

SEQ ID NO: 122044 - DNA, 25 bp, Homo sapien
tttgtaacaatttaggcgctacctc

SEQ ID NO: 122045 - DNA, 25 bp, Homo sapien
tttgtaacgatttaggcgctacctc

SEQ ID NO: 122046 - DNA, 25 bp, Homo sapien
tttgtaagggtttcagattaaacat

SEQ ID NO: 122047 - DNA, 25 bp, Homo sapien
tttgtaagggtttcaggttaaacat

SEQ ID NO: 122048 - DNA, 25 bp, Homo sapien
tttgtaagtccacacgctcaggttt

SEQ ID NO: 122049 - DNA, 25 bp, Homo sapien
tttgtaagtccacatgctcaggttt

SEQ ID NO: 122050 - DNA, 25 bp, Homo sapien
tttgtaatgcatgacccaaagtgtt

SEQ ID NO: 122051 - DNA, 25 bp, Homo sapien
tttgtaatgcatgtcccaaagtgtt

SEQ ID NO: 122052 - DNA, 25 bp, Homo sapien
tttgtaattttcattgctctccttg

SEQ ID NO: 122053 - DNA, 25 bp, Homo sapien
tttgtaattttcgttgctctccttg

SEQ ID NO: 122054 - DNA, 25 bp, Homo sapien
tttgtacaacagcaatgacccaaac

SEQ ID NO: 122055 - DNA, 25 bp, Homo sapien
tttgtacaacagcactgacccaaac

SEQ ID NO: 122056 - DNA, 25 bp, Homo sapien
tttgtacacgtagctattttcagta

SEQ ID NO: 122057 - DNA, 25 bp, Homo sapien
tttgtacacttagctattttcagta

SEQ ID NO: 122058 - DNA, 25 bp, Homo sapien
tttgtacatcttaaaaattgacatt

SEQ ID NO: 122059 - DNA, 25 bp, Homo sapien
tttgtacatcttgaaaattgacatt

SEQ ID NO: 122060 - DNA, 25 bp, Homo sapien
tttgtacattaattcaacaagcaca

SEQ ID NO: 122061 - DNA, 25 bp, Homo sapien
tttgtacattaattcagcaagcaca

SEQ ID NO: 122062 - DNA, 25 bp, Homo sapien
tttgtaccacatggaaatttgtgcc

SEQ ID NO: 122063 - DNA, 25 bp, Homo sapien
tttgtaccacatggaagtttgtgcc

SEQ ID NO: 122064 - DNA, 25 bp, Homo sapien
tttgtacctttcaatttcaacaaat

SEQ ID NO: 122065 - DNA, 25 bp, Homo sapien
tttgtacctttcattttcaacaaat

SEQ ID NO: 122066 - DNA, 25 bp, Homo sapien
tttgtactcagctggtcataaaatc

SEQ ID NO: 122067 - DNA, 25 bp, Homo sapien
tttgtactctactggctgttctgca

SEQ ID NO: 122068 - DNA, 25 bp, Homo sapien
tttgtactctattggctgttctgca

SEQ ID NO: 122069 - DNA, 25 bp, Homo sapien
tttgtactctgctggtcataaaatc

SEQ ID NO: 122070 - DNA, 25 bp, Homo sapien
tttgtacttcctgtcagtcaggcag

SEQ ID NO: 122071 - DNA, 25 bp, Homo sapien
tttgtacttcctgttagtcaggcag

SEQ ID NO: 122072 - DNA, 25 bp, Homo sapien
tttgtagaaaggagtgatgtgatct

SEQ ID NO: 122073 - DNA, 25 bp, Homo sapien
tttgtagaaaggtgtgatgtgatct

SEQ ID NO: 122074 - DNA, 25 bp, Homo sapien
tttgtagaaaggttgttggttggtt

SEQ ID NO: 122075 - DNA, 25 bp, Homo sapien
tttgtagaactgaggtaataatatc

SEQ ID NO: 122076 - DNA, 25 bp, Homo sapien
tttgtagaagggttgttggttggtt

SEQ ID NO: 122077 - DNA, 25 bp, Homo sapien
tttgtagaattgaggtaataatatc

SEQ ID NO: 122078 - DNA, 25 bp, Homo sapien
tttgtagacatgattaagagcatct

SEQ ID NO: 122079 - DNA, 25 bp, Homo sapien
tttgtagacatggttaagagcatct

SEQ ID NO: 122080 - DNA, 25 bp, Homo sapien
tttgtagaggtttaaaaatatacta

SEQ ID NO: 122081 - DNA, 25 bp, Homo sapien
tttgtagaggtttagaaatatacta

SEQ ID NO: 122082 - DNA, 25 bp, Homo sapien
tttgtagagtgaaaattgagcaaat

SEQ ID NO: 122083 - DNA, 25 bp, Homo sapien
tttgtagagtgaaagttgagcaaat

SEQ ID NO: 122084 - DNA, 25 bp, Homo sapien
tttgtagcataactagaagtcaggg

SEQ ID NO: 122085 - DNA, 25 bp, Homo sapien
tttgtagcatcaattgtttcatttc

SEQ ID NO: 122086 - DNA, 25 bp, Homo sapien
tttgtagcatcacttgtttcatttc

SEQ ID NO: 122087 - DNA, 25 bp, Homo sapien
tttgtagcgtaactagaagtcaggg

SEQ ID NO: 122088 - DNA, 25 bp, Homo sapien
tttgtaggaggaacgagctggaaat

SEQ ID NO: 122089 - DNA, 25 bp, Homo sapien
tttgtaggaggaatgagctggaaat

SEQ ID NO: 122090 - DNA, 25 bp, Homo sapien
tttgtagtctcataacaccctgaat

SEQ ID NO: 122091 - DNA, 25 bp, Homo sapien
tttgtagtttcataacaccctgaat

SEQ ID NO: 122092 - DNA, 25 bp, Homo sapien
tttgtatgaaatagaactccaaggc

SEQ ID NO: 122093 - DNA, 25 bp, Homo sapien
tttgtatgaaatagcactccaaggc

SEQ ID NO: 122094 - DNA, 25 bp, Homo sapien
tttgtattattgtctcagacctcaa

SEQ ID NO: 122095 - DNA, 25 bp, Homo sapien
tttgtattcctgctctgtagtctct

SEQ ID NO: 122096 - DNA, 25 bp, Homo sapien
tttgtattcttgtctcagacctcaa

SEQ ID NO: 122097 - DNA, 25 bp, Homo sapien
tttgtattgcttcatccctgcccca

SEQ ID NO: 122098 - DNA, 25 bp, Homo sapien
tttgtattgcttcgtccctgcccca

SEQ ID NO: 122099 - DNA, 25 bp, Homo sapien
tttgtatttctgctctgtagtctct

SEQ ID NO: 122100 - DNA, 25 bp, Homo sapien
tttgtatttgcagtcttctgcttta

SEQ ID NO: 122101 - DNA, 25 bp, Homo sapien
tttgtatttggatgtctggatctct

SEQ ID NO: 122102 - DNA, 25 bp, Homo sapien
tttgtatttggatttctggatctct

SEQ ID NO: 122103 - DNA, 25 bp, Homo sapien
tttgtattttcagtcttctgcttta

SEQ ID NO: 122104 - DNA, 25 bp, Homo sapien
tttgtattttctacctaattggcac

SEQ ID NO: 122105 - DNA, 25 bp, Homo sapien
tttgtattttctccctaattggcac

SEQ ID NO: 122106 - DNA, 25 bp, Homo sapien
tttgtatttttcactttagattcat

SEQ ID NO: 122107 - DNA, 25 bp, Homo sapien
tttgtatttttcattttagattcat

SEQ ID NO: 122108 - DNA, 25 bp, Homo sapien
tttgtcaaacttctgagctgagaga

SEQ ID NO: 122109 - DNA, 25 bp, Homo sapien
tttgtcaaacttttgagctgagaga

SEQ ID NO: 122110 - DNA, 25 bp, Homo sapien
tttgtcaaagaactacataagcttc

SEQ ID NO: 122111 - DNA, 25 bp, Homo sapien
tttgtcaaagaactacgtaagcttc

SEQ ID NO: 122112 - DNA, 25 bp, Homo sapien
tttgtcaacaaatttggacactttg

SEQ ID NO: 122113 - DNA, 25 bp, Homo sapien
tttgtcaagagacacttacaagatg

SEQ ID NO: 122114 - DNA, 25 bp, Homo sapien
tttgtcaagagatacttacaagatg

SEQ ID NO: 122115 - DNA, 25 bp, Homo sapien
tttgtcaataaatttggacactttg

SEQ ID NO: 122116 - DNA, 25 bp, Homo sapien
tttgtcaatccataatctgataggt

SEQ ID NO: 122117 - DNA, 25 bp, Homo sapien
tttgtcaatccgtaatctgataggt

SEQ ID NO: 122118 - DNA, 25 bp, Homo sapien
tttgtcacacgaagagagctgtgaa

SEQ ID NO: 122119 - DNA, 25 bp, Homo sapien
tttgtcacatgaagagagctgtgaa

SEQ ID NO: 122120 - DNA, 25 bp, Homo sapien
tttgtcacgattgtgttcactgtag

SEQ ID NO: 122121 - DNA, 25 bp, Homo sapien
tttgtcacggttgtgttcactgtag

SEQ ID NO: 122122 - DNA, 25 bp, Homo sapien
tttgtcactatttgacctgtctggc

SEQ ID NO: 122123 - DNA, 25 bp, Homo sapien
tttgtcactttttgacctgtctggc

SEQ ID NO: 122124 - DNA, 25 bp, Homo sapien
tttgtcagaaaacgaagtcattact

SEQ ID NO: 122125 - DNA, 25 bp, Homo sapien
tttgtcagaaaatgaagtcattact

SEQ ID NO: 122126 - DNA, 25 bp, Homo sapien
tttgtcagagaaccaccagctccaa

SEQ ID NO: 122127 - DNA, 25 bp, Homo sapien
tttgtcagagaagcaccagctccaa

SEQ ID NO: 122128 - DNA, 25 bp, Homo sapien
tttgtcagagccttatcccagctgg

SEQ ID NO: 122129 - DNA, 25 bp, Homo sapien
tttgtcagatccttatcccagctgg

SEQ ID NO: 122130 - DNA, 25 bp, Homo sapien
tttgtcagtcttacgatttctattt

SEQ ID NO: 122131 - DNA, 25 bp, Homo sapien
tttgtcagtcttatgatttctattt

SEQ ID NO: 122132 - DNA, 25 bp, Homo sapien
tttgtcatttccatgttttctattt

SEQ ID NO: 122133 - DNA, 25 bp, Homo sapien
tttgtcatttccattttttctattt

SEQ ID NO: 122134 - DNA, 25 bp, Homo sapien
tttgtccagtatcttcttttttgat

SEQ ID NO: 122135 - DNA, 25 bp, Homo sapien
tttgtccagtatgttcttttttgat

SEQ ID NO: 122136 - DNA, 25 bp, Homo sapien
tttgtccctcggaacagagcacagt

SEQ ID NO: 122137 - DNA, 25 bp, Homo sapien
tttgtcccttggaacagagcacagt

SEQ ID NO: 122138 - DNA, 25 bp, Homo sapien
tttgtcctatacctgtgaagatgag

SEQ ID NO: 122139 - DNA, 25 bp, Homo sapien
tttgtcctatacgtgtgaagatgag

SEQ ID NO: 122140 - DNA, 25 bp, Homo sapien
tttgtccttacagagtttgtggtct

SEQ ID NO: 122141 - DNA, 25 bp, Homo sapien
tttgtccttacggagtttgtggtct

SEQ ID NO: 122142 - DNA, 25 bp, Homo sapien
tttgtccttgcagacctcctggaat

SEQ ID NO: 122143 - DNA, 25 bp, Homo sapien
tttgtccttgcagagctcctggaat

SEQ ID NO: 122144 - DNA, 25 bp, Homo sapien
tttgtcgtagtctggaactattttg

SEQ ID NO: 122145 - DNA, 25 bp, Homo sapien
tttgtcgtcgtctggaactattttg

SEQ ID NO: 122146 - DNA, 25 bp, Homo sapien
tttgtctacataagatcctgctcat

SEQ ID NO: 122147 - DNA, 25 bp, Homo sapien
tttgtctacatcaacaatcatttgc

SEQ ID NO: 122148 - DNA, 25 bp, Homo sapien
tttgtctacattaacaatcatttgc

SEQ ID NO: 122149 - DNA, 25 bp, Homo sapien
tttgtctaggcacattgtcccatta

SEQ ID NO: 122150 - DNA, 25 bp, Homo sapien
tttgtctagtcacattgtcccatta

SEQ ID NO: 122151 - DNA, 25 bp, Homo sapien
tttgtctatataagatcctgctcat

SEQ ID NO: 122152 - DNA, 25 bp, Homo sapien
tttgtctgatgaatgtactttagaa

SEQ ID NO: 122153 - DNA, 25 bp, Homo sapien
tttgtctgatgaatgtcctttagaa

SEQ ID NO: 122154 - DNA, 25 bp, Homo sapien
tttgtctgcaagagtgctcttgttt

SEQ ID NO: 122155 - DNA, 25 bp, Homo sapien
tttgtctgcaagagtggtcttgttt

SEQ ID NO: 122156 - DNA, 25 bp, Homo sapien
tttgtctgcgaaaatctataactct

SEQ ID NO: 122157 - DNA, 25 bp, Homo sapien
tttgtctgtgaaaatctataactct

SEQ ID NO: 122158 - DNA, 25 bp, Homo sapien
tttgtcttattatccaattgttttg

SEQ ID NO: 122159 - DNA, 25 bp, Homo sapien
tttgtcttattatccagttgttttg

SEQ ID NO: 122160 - DNA, 25 bp, Homo sapien
tttgtctttatcgtttgttagagtt

SEQ ID NO: 122161 - DNA, 25 bp, Homo sapien
tttgtctttatcttttgttagagtt

SEQ ID NO: 122162 - DNA, 25 bp, Homo sapien
tttgtctttcacaattgcctagaaa

SEQ ID NO: 122163 - DNA, 25 bp, Homo sapien
tttgtctttcataattgcctagaaa

SEQ ID NO: 122164 - DNA, 25 bp, Homo sapien
tttgtctttccagaaggcttcccaa

SEQ ID NO: 122165 - DNA, 25 bp, Homo sapien
tttgtctttccagaagtcttcccaa

SEQ ID NO: 122166 - DNA, 25 bp, Homo sapien
tttgtctttggacattttcaccttt

SEQ ID NO: 122167 - DNA, 25 bp, Homo sapien
tttgtctttggacgttttcaccttt

SEQ ID NO: 122168 - DNA, 25 bp, Homo sapien
tttgtcttttacatttttcacttaa

SEQ ID NO: 122169 - DNA, 25 bp, Homo sapien
tttgtcttttacgtttttcacttaa

SEQ ID NO: 122170 - DNA, 25 bp, Homo sapien
tttgtgaaatctcaacctaggagca

SEQ ID NO: 122171 - DNA, 25 bp, Homo sapien
tttgtgaaatctcaacgtaggagca

SEQ ID NO: 122172 - DNA, 25 bp, Homo sapien
tttgtgaactgaccttcccattcct

SEQ ID NO: 122173 - DNA, 25 bp, Homo sapien
tttgtgaactgacctttccattcct

SEQ ID NO: 122174 - DNA, 25 bp, Homo sapien
tttgtgacatgtaataaatgttcaa

SEQ ID NO: 122175 - DNA, 25 bp, Homo sapien
tttgtgaccatcataccgtggtttg

SEQ ID NO: 122176 - DNA, 25 bp, Homo sapien
tttgtgaccatcatactgtggtttg

SEQ ID NO: 122177 - DNA, 25 bp, Homo sapien
tttgtgacgtgtaataaatgttcaa

SEQ ID NO: 122178 - DNA, 25 bp, Homo sapien
tttgtgagaatcctcttttacattc

SEQ ID NO: 122179 - DNA, 25 bp, Homo sapien
tttgtgagacgcacaattcacagag

SEQ ID NO: 122180 - DNA, 25 bp, Homo sapien
tttgtgagagtcctcttttacattc

SEQ ID NO: 122181 - DNA, 25 bp, Homo sapien
tttgtgagatgcacaattcacagag

SEQ ID NO: 122182 - DNA, 25 bp, Homo sapien
tttgtgagtaatcaaacagttgata

SEQ ID NO: 122183 - DNA, 25 bp, Homo sapien
tttgtgagtaatcagacagttgata

SEQ ID NO: 122184 - DNA, 25 bp, Homo sapien
tttgtgatccgcttggctgacctgg

SEQ ID NO: 122185 - DNA, 25 bp, Homo sapien
tttgtgatctgcttggctgacctgg

SEQ ID NO: 122186 - DNA, 25 bp, Homo sapien
tttgtgcaaatcctaggtgctcaat

SEQ ID NO: 122187 - DNA, 25 bp, Homo sapien
tttgtgcaaatcttaggtgctcaat

SEQ ID NO: 122188 - DNA, 25 bp, Homo sapien
tttgtgcaacatcggtgcagtttgg

SEQ ID NO: 122189 - DNA, 25 bp, Homo sapien
tttgtgcaacattggtgcagtttgg

SEQ ID NO: 122190 - DNA, 25 bp, Homo sapien
tttgtgcacatttgcccgcaccttc

SEQ ID NO: 122191 - DNA, 25 bp, Homo sapien
tttgtgcacatttgcctgcaccttc

SEQ ID NO: 122192 - DNA, 25 bp, Homo sapien
tttgtgcacttaacccatctgtaga

SEQ ID NO: 122193 - DNA, 25 bp, Homo sapien
tttgtgcacttgacccatctgtaga

SEQ ID NO: 122194 - DNA, 25 bp, Homo sapien
tttgtgcagaaaatcgtaagtagct

SEQ ID NO: 122195 - DNA, 25 bp, Homo sapien
tttgtgcagaaaattgtaagtagct

SEQ ID NO: 122196 - DNA, 25 bp, Homo sapien
tttgtgccacaagaatgttaagttc

SEQ ID NO: 122197 - DNA, 25 bp, Homo sapien
tttgtgccacaagcatgttaagttc

SEQ ID NO: 122198 - DNA, 25 bp, Homo sapien
tttgtgctcgtggagacgctggtgg

SEQ ID NO: 122199 - DNA, 25 bp, Homo sapien
tttgtgctcgtggagatgctggtgg

SEQ ID NO: 122200 - DNA, 25 bp, Homo sapien
tttgtggagtcccagaagcatgatg

SEQ ID NO: 122201 - DNA, 25 bp, Homo sapien
tttgtggagtctcagaagcatgatg

SEQ ID NO: 122202 - DNA, 25 bp, Homo sapien
tttgtggatcataggcccccagcaa

SEQ ID NO: 122203 - DNA, 25 bp, Homo sapien
tttgtggatcatgggcccccagcaa

SEQ ID NO: 122204 - DNA, 25 bp, Homo sapien
tttgtggccaaccaaaatctccata

SEQ ID NO: 122205 - DNA, 25 bp, Homo sapien
tttgtggccaaccgaaatctccata

SEQ ID NO: 122206 - DNA, 25 bp, Homo sapien
tttgtggccatgtttccgtgtcaga

SEQ ID NO: 122207 - DNA, 25 bp, Homo sapien
tttgtggcctttacttatgcagtat

SEQ ID NO: 122208 - DNA, 25 bp, Homo sapien
tttgtggcctttagttatgcagtat

SEQ ID NO: 122209 - DNA, 25 bp, Homo sapien
tttgtggctacaaactgaagaacaa

SEQ ID NO: 122210 - DNA, 25 bp, Homo sapien
tttgtggctatgtttccgtgtcaga

SEQ ID NO: 122211 - DNA, 25 bp, Homo sapien
tttgtggctgcaaactgaagaacaa

SEQ ID NO: 122212 - DNA, 25 bp, Homo sapien
tttgtgggagaacagttactatgat

SEQ ID NO: 122213 - DNA, 25 bp, Homo sapien
tttgtgggagaacggttactatgat

SEQ ID NO: 122214 - DNA, 25 bp, Homo sapien
tttgtgggatagttagttgtgtgca

SEQ ID NO: 122215 - DNA, 25 bp, Homo sapien
tttgtgggattaggttctcctgatc

SEQ ID NO: 122216 - DNA, 25 bp, Homo sapien
tttgtgggattatgttctcctgatc

SEQ ID NO: 122217 - DNA, 25 bp, Homo sapien
tttgtggggtagttagttgtgtgca

SEQ ID NO: 122218 - DNA, 25 bp, Homo sapien
tttgtggggtcaattccagtatcaa

SEQ ID NO: 122219 - DNA, 25 bp, Homo sapien
tttgtggggtcatttccagtatcaa

SEQ ID NO: 122220 - DNA, 25 bp, Homo sapien
tttgtggtaacaacaatagagacct

SEQ ID NO: 122221 - DNA, 25 bp, Homo sapien
tttgtggtaacagcaatagagacct

SEQ ID NO: 122222 - DNA, 25 bp, Homo sapien
tttgtggtcattctcctcactcgaa

SEQ ID NO: 122223 - DNA, 25 bp, Homo sapien
tttgtggtcattttcctcactcgaa

SEQ ID NO: 122224 - DNA, 25 bp, Homo sapien
tttgtggtcttcagtaagttgtatg

SEQ ID NO: 122225 - DNA, 25 bp, Homo sapien
tttgtggtctttagtaagttgtatg

SEQ ID NO: 122226 - DNA, 25 bp, Homo sapien
tttgtggttaaaggtgaagatgtgg

SEQ ID NO: 122227 - DNA, 25 bp, Homo sapien
tttgtggttaaatgtgaagatgtgg

SEQ ID NO: 122228 - DNA, 25 bp, Homo sapien
tttgtgtaatacttccaatatcata

SEQ ID NO: 122229 - DNA, 25 bp, Homo sapien
tttgtgtaatacttccgatatcata

SEQ ID NO: 122230 - DNA, 25 bp, Homo sapien
tttgtgtcacgtaaagtgctattaa

SEQ ID NO: 122231 - DNA, 25 bp, Homo sapien
tttgtgtcaggaaaagcctatttat

SEQ ID NO: 122232 - DNA, 25 bp, Homo sapien
tttgtgtcaggaaaggcctatttat

SEQ ID NO: 122233 - DNA, 25 bp, Homo sapien
tttgtgtcatgtaaagtgctattaa

SEQ ID NO: 122234 - DNA, 25 bp, Homo sapien
tttgtgtcttgctgccttcagtctt

SEQ ID NO: 122235 - DNA, 25 bp, Homo sapien
tttgtgtcttgctggcttcagtctt

SEQ ID NO: 122236 - DNA, 25 bp, Homo sapien
tttgtgtgacttttgcaatgtgttg

SEQ ID NO: 122237 - DNA, 25 bp, Homo sapien
tttgtgtgacttttgccatgtgttg

SEQ ID NO: 122238 - DNA, 25 bp, Homo sapien
tttgtgtggagccgttttcctgtag

SEQ ID NO: 122239 - DNA, 25 bp, Homo sapien
tttgtgtggagctgttttcctgtag

SEQ ID NO: 122240 - DNA, 25 bp, Homo sapien
tttgtgttgtacgctgttattgtga

SEQ ID NO: 122241 - DNA, 25 bp, Homo sapien
tttgtgtttaggctgtagctggccc

SEQ ID NO: 122242 - DNA, 25 bp, Homo sapien
tttgtgtttaggttgtagctggccc

SEQ ID NO: 122243 - DNA, 25 bp, Homo sapien
tttgtgtttcctcggatacagaaat

SEQ ID NO: 122244 - DNA, 25 bp, Homo sapien
tttgtgtttccttggatacagaaat

SEQ ID NO: 122245 - DNA, 25 bp, Homo sapien
tttgtgtttcttataatgcaacaaa

SEQ ID NO: 122246 - DNA, 25 bp, Homo sapien
tttgtgtttgttataatgcaacaaa

SEQ ID NO: 122247 - DNA, 25 bp, Homo sapien
tttgtgttttacgctgttattgtga

SEQ ID NO: 122248 - DNA, 25 bp, Homo sapien
tttgtgttttccgctaggttgcttt

SEQ ID NO: 122249 - DNA, 25 bp, Homo sapien
tttgtgttttcctctaggttgcttt

SEQ ID NO: 122250 - DNA, 25 bp, Homo sapien
tttgttaaagcacacattgctgggc

SEQ ID NO: 122251 - DNA, 25 bp, Homo sapien
tttgttaaagcacagattgctgggc

SEQ ID NO: 122252 - DNA, 25 bp, Homo sapien
tttgttagaacccatggttgccacg

SEQ ID NO: 122253 - DNA, 25 bp, Homo sapien
tttgttagaactcatggttgccacg

SEQ ID NO: 122254 - DNA, 25 bp, Homo sapien
tttgttcacactccactgtatccct

SEQ ID NO: 122255 - DNA, 25 bp, Homo sapien
tttgttcacacttcactgtatccct

SEQ ID NO: 122256 - DNA, 25 bp, Homo sapien
tttgttcacatttttaacagaagca

SEQ ID NO: 122257 - DNA, 25 bp, Homo sapien
tttgttcacgtttttaacagaagca

SEQ ID NO: 122258 - DNA, 25 bp, Homo sapien
tttgttcagtcgtctaataatttta

SEQ ID NO: 122259 - DNA, 25 bp, Homo sapien
tttgttcagtcttctaataatttta

SEQ ID NO: 122260 - DNA, 25 bp, Homo sapien
tttgttcatgctgcaattttcttta

SEQ ID NO: 122261 - DNA, 25 bp, Homo sapien
tttgttcatgctgcgattttcttta

SEQ ID NO: 122262 - DNA, 25 bp, Homo sapien
tttgttcattaaggtgattattgga

SEQ ID NO: 122263 - DNA, 25 bp, Homo sapien
tttgttcattagggtgattattgga

SEQ ID NO: 122264 - DNA, 25 bp, Homo sapien
tttgttccatatagcagagcaagtt

SEQ ID NO: 122265 - DNA, 25 bp, Homo sapien
tttgttccattggtctgtatatcca

SEQ ID NO: 122266 - DNA, 25 bp, Homo sapien
tttgttccgtatagcagagcaagtt

SEQ ID NO: 122267 - DNA, 25 bp, Homo sapien
tttgttccgttggtctgtatatcca

SEQ ID NO: 122268 - DNA, 25 bp, Homo sapien
tttgttctatcacccgtatctgcta

SEQ ID NO: 122269 - DNA, 25 bp, Homo sapien
tttgttctatcatccgtatctgcta

SEQ ID NO: 122270 - DNA, 25 bp, Homo sapien
tttgttctctggcaatgtgaatatt

SEQ ID NO: 122271 - DNA, 25 bp, Homo sapien
tttgttctctggctatgtgaatatt

SEQ ID NO: 122272 - DNA, 25 bp, Homo sapien
tttgttctgaggatagtggcctttg

SEQ ID NO: 122273 - DNA, 25 bp, Homo sapien
tttgttctgagggtagtggcctttg

SEQ ID NO: 122274 - DNA, 25 bp, Homo sapien
tttgttcttagaataaatgacaata

SEQ ID NO: 122275 - DNA, 25 bp, Homo sapien
tttgttcttagagtaaatgacaata

SEQ ID NO: 122276 - DNA, 25 bp, Homo sapien
tttgttctttacagagcctcattat

SEQ ID NO: 122277 - DNA, 25 bp, Homo sapien
tttgttctttacagagtctcattat

SEQ ID NO: 122278 - DNA, 25 bp, Homo sapien
tttgttgatgctaagcttgcatgta

SEQ ID NO: 122279 - DNA, 25 bp, Homo sapien
tttgttgatgctatgcttgcatgta

SEQ ID NO: 122280 - DNA, 25 bp, Homo sapien
tttgttggctcatataatggtaaag

SEQ ID NO: 122281 - DNA, 25 bp, Homo sapien
tttgttggttcatataatggtaaag

SEQ ID NO: 122282 - DNA, 25 bp, Homo sapien
tttgttgtcatattatctctaggca

SEQ ID NO: 122283 - DNA, 25 bp, Homo sapien
tttgttgtcatattatttctaggca

SEQ ID NO: 122284 - DNA, 25 bp, Homo sapien
tttgttgtcctccgattttatcata

SEQ ID NO: 122285 - DNA, 25 bp, Homo sapien
tttgttgtcctctgattttatcata

SEQ ID NO: 122286 - DNA, 25 bp, Homo sapien
tttgttgttgtaaaggtgtgggcaa

SEQ ID NO: 122287 - DNA, 25 bp, Homo sapien
tttgttgttgtaaatgtgtgggcaa

SEQ ID NO: 122288 - DNA, 25 bp, Homo sapien
tttgttgtttcacttatagaacaca

SEQ ID NO: 122289 - DNA, 25 bp, Homo sapien
tttgttgtttcgcttatagaacaca

SEQ ID NO: 122290 - DNA, 25 bp, Homo sapien
tttgtttaaagccactagtattagt

SEQ ID NO: 122291 - DNA, 25 bp, Homo sapien
tttgtttaaagccattagtattagt

SEQ ID NO: 122292 - DNA, 25 bp, Homo sapien
tttgtttagaaagcagtgggttcta

SEQ ID NO: 122293 - DNA, 25 bp, Homo sapien
tttgtttaggaagcagtgggttcta

SEQ ID NO: 122294 - DNA, 25 bp, Homo sapien
tttgtttatccatgagttgtttaat

SEQ ID NO: 122295 - DNA, 25 bp, Homo sapien
tttgtttatccgtgagttgtttaat

SEQ ID NO: 122296 - DNA, 25 bp, Homo sapien
tttgtttcaaagtacatgtaacatt

SEQ ID NO: 122297 - DNA, 25 bp, Homo sapien
tttgtttcaaagtatatgtaacatt

SEQ ID NO: 122298 - DNA, 25 bp, Homo sapien
tttgtttcaatccagcaatcccact

SEQ ID NO: 122299 - DNA, 25 bp, Homo sapien
tttgtttcaatccggcaatcccact

SEQ ID NO: 122300 - DNA, 25 bp, Homo sapien
tttgtttccctggttttctactatg

SEQ ID NO: 122301 - DNA, 25 bp, Homo sapien
tttgtttccctgtttttctactatg

SEQ ID NO: 122302 - DNA, 25 bp, Homo sapien
tttgtttccttaagctcttaactac

SEQ ID NO: 122303 - DNA, 25 bp, Homo sapien
tttgtttccttaggctcttaactac

SEQ ID NO: 122304 - DNA, 25 bp, Homo sapien
tttgtttcctttttagacataccag

SEQ ID NO: 122305 - DNA, 25 bp, Homo sapien
tttgtttctgagaccaggaaataac

SEQ ID NO: 122306 - DNA, 25 bp, Homo sapien
tttgtttcttagaccaggaaataac

SEQ ID NO: 122307 - DNA, 25 bp, Homo sapien
tttgtttcttttttagacataccag

SEQ ID NO: 122308 - DNA, 25 bp, Homo sapien
tttgtttgaaatgccagatatagca

SEQ ID NO: 122309 - DNA, 25 bp, Homo sapien
tttgtttgaaatgtcagatatagca

SEQ ID NO: 122310 - DNA, 25 bp, Homo sapien
tttgtttgactagttctcattcaat

SEQ ID NO: 122311 - DNA, 25 bp, Homo sapien
tttgtttgactggttctcattcaat

SEQ ID NO: 122312 - DNA, 25 bp, Homo sapien
tttgtttggagaaatttacttgcct

SEQ ID NO: 122313 - DNA, 25 bp, Homo sapien
tttgtttggagaattttacttgcct

SEQ ID NO: 122314 - DNA, 25 bp, Homo sapien
tttgtttggtgcacccatatttgtt

SEQ ID NO: 122315 - DNA, 25 bp, Homo sapien
tttgtttggtgcactcatatttgtt

SEQ ID NO: 122316 - DNA, 25 bp, Homo sapien
tttgttttagtaggcagctaatttg

SEQ ID NO: 122317 - DNA, 25 bp, Homo sapien
tttgttttatcccaagccattgtgc

SEQ ID NO: 122318 - DNA, 25 bp, Homo sapien
tttgttttatcccaggccattgtgc

SEQ ID NO: 122319 - DNA, 25 bp, Homo sapien
tttgttttatttattgcagtatatt

SEQ ID NO: 122320 - DNA, 25 bp, Homo sapien
tttgttttatttattggagtatatt

SEQ ID NO: 122321 - DNA, 25 bp, Homo sapien
tttgttttccaatagaaatcattca

SEQ ID NO: 122322 - DNA, 25 bp, Homo sapien
tttgttttccagtagaaatcattca

SEQ ID NO: 122323 - DNA, 25 bp, Homo sapien
tttgttttcgtaggcagctaatttg

SEQ ID NO: 122324 - DNA, 25 bp, Homo sapien
tttgttttcttaacatttgtgtatt

SEQ ID NO: 122325 - DNA, 25 bp, Homo sapien
tttgttttcttaatatttgtgtatt

SEQ ID NO: 122326 - DNA, 25 bp, Homo sapien
tttgtttttagtttctcaggctgtg

SEQ ID NO: 122327 - DNA, 25 bp, Homo sapien
tttgtttttatagaggcggagtttc

SEQ ID NO: 122328 - DNA, 25 bp, Homo sapien
tttgtttttattgaggcggagtttc

SEQ ID NO: 122329 - DNA, 25 bp, Homo sapien
tttgtttttctcctgaatgaaacca

SEQ ID NO: 122330 - DNA, 25 bp, Homo sapien
tttgtttttctcctgagtgaaacca

SEQ ID NO: 122331 - DNA, 25 bp, Homo sapien
tttgttttttagtcacttgttaaaa

SEQ ID NO: 122332 - DNA, 25 bp, Homo sapien
tttgttttttagtcgcttgttaaaa

SEQ ID NO: 122333 - DNA, 25 bp, Homo sapien
tttgttttttgtttctcaggctgtg

SEQ ID NO: 122334 - DNA, 25 bp, Homo sapien
ttttaaaaaatgaagagtctgtcaa

SEQ ID NO: 122335 - DNA, 25 bp, Homo sapien
ttttaaaaaatgacgagtctgtcaa

SEQ ID NO: 122336 - DNA, 25 bp, Homo sapien
ttttaaaaagcaggtgccccttctg

SEQ ID NO: 122337 - DNA, 25 bp, Homo sapien
ttttaaaaatcaggtgccccttctg

SEQ ID NO: 122338 - DNA, 25 bp, Homo sapien
ttttaaaacaagccatgtgttagtc

SEQ ID NO: 122339 - DNA, 25 bp, Homo sapien
ttttaaaacaatccatgtgttagtc

SEQ ID NO: 122340 - DNA, 25 bp, Homo sapien
ttttaaaacctgatggacctttgtg

SEQ ID NO: 122341 - DNA, 25 bp, Homo sapien
ttttaaaacgaggtaagagtttaag

SEQ ID NO: 122342 - DNA, 25 bp, Homo sapien
ttttaaaacgagttaagagtttaag

SEQ ID NO: 122343 - DNA, 25 bp, Homo sapien
ttttaaaacttgatggacctttgtg

SEQ ID NO: 122344 - DNA, 25 bp, Homo sapien
ttttaaaatactagtgctacaaaga

SEQ ID NO: 122345 - DNA, 25 bp, Homo sapien
ttttaaaattctagtgctacaaaga

SEQ ID NO: 122346 - DNA, 25 bp, Homo sapien
ttttaaacaatcaaacatggactta

SEQ ID NO: 122347 - DNA, 25 bp, Homo sapien
ttttaaacaatcaatagaatatgat

SEQ ID NO: 122348 - DNA, 25 bp, Homo sapien
ttttaaacaatcagtagaatatgat

SEQ ID NO: 122349 - DNA, 25 bp, Homo sapien
ttttaaacacggcacttttggccac

SEQ ID NO: 122350 - DNA, 25 bp, Homo sapien
ttttaaacacggcgcttttggccac

SEQ ID NO: 122351 - DNA, 25 bp, Homo sapien
ttttaaacatactacacattcaatt

SEQ ID NO: 122352 - DNA, 25 bp, Homo sapien
ttttaaacatactgcacattcaatt

SEQ ID NO: 122353 - DNA, 25 bp, Homo sapien
ttttaaacccggtaagagaggatga

SEQ ID NO: 122354 - DNA, 25 bp, Homo sapien
ttttaaacctggtaagagaggatga

SEQ ID NO: 122355 - DNA, 25 bp, Homo sapien
ttttaaacgatcaaacatggactta

SEQ ID NO: 122356 - DNA, 25 bp, Homo sapien
ttttaaactcaagacttcctcatag

SEQ ID NO: 122357 - DNA, 25 bp, Homo sapien
ttttaaactcaagtcttcctcatag

SEQ ID NO: 122358 - DNA, 25 bp, Homo sapien
ttttaaagaatcagagttttttcag

SEQ ID NO: 122359 - DNA, 25 bp, Homo sapien
ttttaaagaatcggagttttttcag

SEQ ID NO: 122360 - DNA, 25 bp, Homo sapien
ttttaaagaatctgctgactgattc

SEQ ID NO: 122361 - DNA, 25 bp, Homo sapien
ttttaaagaatctggtgactgattc

SEQ ID NO: 122362 - DNA, 25 bp, Homo sapien
ttttaaagaattgacgaaggaaaat

SEQ ID NO: 122363 - DNA, 25 bp, Homo sapien
ttttaaagaattgatgaaggaaaat

SEQ ID NO: 122364 - DNA, 25 bp, Homo sapien
ttttaaagagtaatgttctcatctt

SEQ ID NO: 122365 - DNA, 25 bp, Homo sapien
ttttaaagagtagtgttctcatctt

SEQ ID NO: 122366 - DNA, 25 bp, Homo sapien
ttttaaagatgaaagtgaattgaga

SEQ ID NO: 122367 - DNA, 25 bp, Homo sapien
ttttaaagatgagagtgaattgaga

SEQ ID NO: 122368 - DNA, 25 bp, Homo sapien
ttttaaagtgacttgtctgcttagc

SEQ ID NO: 122369 - DNA, 25 bp, Homo sapien
ttttaaagtgacttgtttgcttagc

SEQ ID NO: 122370 - DNA, 25 bp, Homo sapien
ttttaaagttggcgttgatggaact

SEQ ID NO: 122371 - DNA, 25 bp, Homo sapien
ttttaaagttggctttgatggaact

SEQ ID NO: 122372 - DNA, 25 bp, Homo sapien
ttttaaatatgttatgatgatgttt

SEQ ID NO: 122373 - DNA, 25 bp, Homo sapien
ttttaaatatgttgtgatgatgttt

SEQ ID NO: 122374 - DNA, 25 bp, Homo sapien
ttttaaatattgacagaaattcaaa

SEQ ID NO: 122375 - DNA, 25 bp, Homo sapien
ttttaaatattgacagcaattcaaa

SEQ ID NO: 122376 - DNA, 25 bp, Homo sapien
ttttaaatatttcacgtaaaccata

SEQ ID NO: 122377 - DNA, 25 bp, Homo sapien
ttttaaatatttcatgtaaaccata

SEQ ID NO: 122378 - DNA, 25 bp, Homo sapien
ttttaaatcacataagctcctcctc

SEQ ID NO: 122379 - DNA, 25 bp, Homo sapien
ttttaaatcacatatgctcctcctc

SEQ ID NO: 122380 - DNA, 25 bp, Homo sapien
ttttaacaaattccatgattgtcag

SEQ ID NO: 122381 - DNA, 25 bp, Homo sapien
ttttaacaaattccgtgattgtcag

SEQ ID NO: 122382 - DNA, 25 bp, Homo sapien
ttttaacacggatattttgcactaa

SEQ ID NO: 122383 - DNA, 25 bp, Homo sapien
ttttaacactcaccatagctcagaa

SEQ ID NO: 122384 - DNA, 25 bp, Homo sapien
ttttaacactcatcatagctcagaa

SEQ ID NO: 122385 - DNA, 25 bp, Homo sapien
ttttaacacttaataagcagcaagc

SEQ ID NO: 122386 - DNA, 25 bp, Homo sapien
ttttaacatggatattttgcactaa

SEQ ID NO: 122387 - DNA, 25 bp, Homo sapien
ttttaacattccaaacatgaatcag

SEQ ID NO: 122388 - DNA, 25 bp, Homo sapien
ttttaacattctaaacatgaatcag

SEQ ID NO: 122389 - DNA, 25 bp, Homo sapien
ttttaacatttaataagcagcaagc

SEQ ID NO: 122390 - DNA, 25 bp, Homo sapien
ttttaagaaaagcaacataagcaac

SEQ ID NO: 122391 - DNA, 25 bp, Homo sapien
ttttaagaaaagcaacgtaagcaac

SEQ ID NO: 122392 - DNA, 25 bp, Homo sapien
ttttaagagcggtagtggcatgtcc

SEQ ID NO: 122393 - DNA, 25 bp, Homo sapien
ttttaagagcggtcgtggcatgtcc

SEQ ID NO: 122394 - DNA, 25 bp, Homo sapien
ttttaagatccagattttttcttta

SEQ ID NO: 122395 - DNA, 25 bp, Homo sapien
ttttaagatccatattttttcttta

SEQ ID NO: 122396 - DNA, 25 bp, Homo sapien
ttttaagcaagcacccgttttcact

SEQ ID NO: 122397 - DNA, 25 bp, Homo sapien
ttttaagcaagcgcccgttttcact

SEQ ID NO: 122398 - DNA, 25 bp, Homo sapien
ttttaagctcaccgttgagagacct

SEQ ID NO: 122399 - DNA, 25 bp, Homo sapien
ttttaagctcactgttgagagacct

SEQ ID NO: 122400 - DNA, 25 bp, Homo sapien
ttttaagtttgccgtttaggctcta

SEQ ID NO: 122401 - DNA, 25 bp, Homo sapien
ttttaagtttgctgtttaggctcta

SEQ ID NO: 122402 - DNA, 25 bp, Homo sapien
ttttaatcacaaggaacaatcagac

SEQ ID NO: 122403 - DNA, 25 bp, Homo sapien
ttttaatcacacggaacaatcagac

SEQ ID NO: 122404 - DNA, 25 bp, Homo sapien
ttttaatcagttcctgaaaatttgt

SEQ ID NO: 122405 - DNA, 25 bp, Homo sapien
ttttaatcagtttctgaaaatttgt

SEQ ID NO: 122406 - DNA, 25 bp, Homo sapien
ttttaatccgtcaggtttccatgtt

SEQ ID NO: 122407 - DNA, 25 bp, Homo sapien
ttttaatctgcactgaagtatttca

SEQ ID NO: 122408 - DNA, 25 bp, Homo sapien
ttttaatctgcattgaagtatttca

SEQ ID NO: 122409 - DNA, 25 bp, Homo sapien
ttttaatctgtcaggtttccatgtt

SEQ ID NO: 122410 - DNA, 25 bp, Homo sapien
ttttaatggcttggatcttttgaat

SEQ ID NO: 122411 - DNA, 25 bp, Homo sapien
ttttaatggcttggctcttttgaat

SEQ ID NO: 122412 - DNA, 25 bp, Homo sapien
ttttaatgtgcatttcctttatgac

SEQ ID NO: 122413 - DNA, 25 bp, Homo sapien
ttttaatgtgcatttcttttatgac

SEQ ID NO: 122414 - DNA, 25 bp, Homo sapien
ttttaattagtcataccttcccata

SEQ ID NO: 122415 - DNA, 25 bp, Homo sapien
ttttaattagtcatactttcccata

SEQ ID NO: 122416 - DNA, 25 bp, Homo sapien
ttttacaaacttacagaaactgaat

SEQ ID NO: 122417 - DNA, 25 bp, Homo sapien
ttttacaaatttacagaaactgaat

SEQ ID NO: 122418 - DNA, 25 bp, Homo sapien
ttttacacacatagcctgttacaaa

SEQ ID NO: 122419 - DNA, 25 bp, Homo sapien
ttttacacatatagcctgttacaaa

SEQ ID NO: 122420 - DNA, 25 bp, Homo sapien
ttttacactcactgactgtgttgct

SEQ ID NO: 122421 - DNA, 25 bp, Homo sapien
ttttacacttactgactgtgttgct

SEQ ID NO: 122422 - DNA, 25 bp, Homo sapien
ttttacagggtcagagtagataatt

SEQ ID NO: 122423 - DNA, 25 bp, Homo sapien
ttttacagggtgagagtagataatt

SEQ ID NO: 122424 - DNA, 25 bp, Homo sapien
ttttacagtctgcagagaaaaatgc

SEQ ID NO: 122425 - DNA, 25 bp, Homo sapien
ttttacagtcttcagagaaaaatgc

SEQ ID NO: 122426 - DNA, 25 bp, Homo sapien
ttttacatacttggttgcttccctt

SEQ ID NO: 122427 - DNA, 25 bp, Homo sapien
ttttacatagttggttgcttccctt

SEQ ID NO: 122428 - DNA, 25 bp, Homo sapien
ttttacatgtctcaaataataccat

SEQ ID NO: 122429 - DNA, 25 bp, Homo sapien
ttttacatgtctcagataataccat

SEQ ID NO: 122430 - DNA, 25 bp, Homo sapien
ttttacatgtttagaaattttggat

SEQ ID NO: 122431 - DNA, 25 bp, Homo sapien
ttttacatgtttagaagttttggat

SEQ ID NO: 122432 - DNA, 25 bp, Homo sapien
ttttacattcatcatacaaaagaat

SEQ ID NO: 122433 - DNA, 25 bp, Homo sapien
ttttacattcatcatataaaagaat

SEQ ID NO: 122434 - DNA, 25 bp, Homo sapien
ttttaccaaggaagactcagtgttg

SEQ ID NO: 122435 - DNA, 25 bp, Homo sapien
ttttaccaaggaagtctcagtgttg

SEQ ID NO: 122436 - DNA, 25 bp, Homo sapien
ttttaccagaactttgaatactaaa

SEQ ID NO: 122437 - DNA, 25 bp, Homo sapien
ttttaccagcactttgaatactaaa

SEQ ID NO: 122438 - DNA, 25 bp, Homo sapien
ttttaccatgccgtttattcatcca

SEQ ID NO: 122439 - DNA, 25 bp, Homo sapien
ttttaccatgctgtttattcatcca

SEQ ID NO: 122440 - DNA, 25 bp, Homo sapien
ttttaccttttagcatgaaagaaaa

SEQ ID NO: 122441 - DNA, 25 bp, Homo sapien
ttttaccttttagcgtgaaagaaaa

SEQ ID NO: 122442 - DNA, 25 bp, Homo sapien
ttttacgctgacaaacccaatctaa

SEQ ID NO: 122443 - DNA, 25 bp, Homo sapien
ttttacgctgaccaacccaatctaa

SEQ ID NO: 122444 - DNA, 25 bp, Homo sapien
ttttactaaatttgattgttcctgg

SEQ ID NO: 122445 - DNA, 25 bp, Homo sapien
ttttactaaatttgtttgttcctgg

SEQ ID NO: 122446 - DNA, 25 bp, Homo sapien
ttttactacaatcaacagaataatg

SEQ ID NO: 122447 - DNA, 25 bp, Homo sapien
ttttactacaatcaacggaataatg

SEQ ID NO: 122448 - DNA, 25 bp, Homo sapien
ttttactcaaggatggccaggtgtg

SEQ ID NO: 122449 - DNA, 25 bp, Homo sapien
ttttactcaaggatggtcaggtgtg

SEQ ID NO: 122450 - DNA, 25 bp, Homo sapien
ttttactgctacgtctctcaggtct

SEQ ID NO: 122451 - DNA, 25 bp, Homo sapien
ttttactgctatgtctctcaggtct

SEQ ID NO: 122452 - DNA, 25 bp, Homo sapien
ttttactgtctaatgcccagaggtg

SEQ ID NO: 122453 - DNA, 25 bp, Homo sapien
ttttactgtctactgcccagaggtg

SEQ ID NO: 122454 - DNA, 25 bp, Homo sapien
ttttacttacttattgaactttgta

SEQ ID NO: 122455 - DNA, 25 bp, Homo sapien
ttttacttatgtaaggaattgtaat

SEQ ID NO: 122456 - DNA, 25 bp, Homo sapien
ttttacttattattacagcttcaat

SEQ ID NO: 122457 - DNA, 25 bp, Homo sapien
ttttacttatttattgaactttgta

SEQ ID NO: 122458 - DNA, 25 bp, Homo sapien
ttttacttctgtaaggaattgtaat

SEQ ID NO: 122459 - DNA, 25 bp, Homo sapien
ttttactttttattacagcttcaat

SEQ ID NO: 122460 - DNA, 25 bp, Homo sapien
ttttagaacaaaaactccaaaagtg

SEQ ID NO: 122461 - DNA, 25 bp, Homo sapien
ttttagaacaaaaacttcaaaagtg

SEQ ID NO: 122462 - DNA, 25 bp, Homo sapien
ttttagaagactgacattgcattac

SEQ ID NO: 122463 - DNA, 25 bp, Homo sapien
ttttagaagactgatattgcattac

SEQ ID NO: 122464 - DNA, 25 bp, Homo sapien
ttttagaagccacaagtttaaagaa

SEQ ID NO: 122465 - DNA, 25 bp, Homo sapien
ttttagaagccgcaagtttaaagaa

SEQ ID NO: 122466 - DNA, 25 bp, Homo sapien
ttttagaatacctcatgagattgaa

SEQ ID NO: 122467 - DNA, 25 bp, Homo sapien
ttttagaatacttcatgagattgaa

SEQ ID NO: 122468 - DNA, 25 bp, Homo sapien
ttttagaattcaaaccattatctgc

SEQ ID NO: 122469 - DNA, 25 bp, Homo sapien
ttttagaattcagaccattatctgc

SEQ ID NO: 122470 - DNA, 25 bp, Homo sapien
ttttagacgataaagtgctaggaga

SEQ ID NO: 122471 - DNA, 25 bp, Homo sapien
ttttagacggtaaagtgctaggaga

SEQ ID NO: 122472 - DNA, 25 bp, Homo sapien
ttttagagacttcaacccaggattt

SEQ ID NO: 122473 - DNA, 25 bp, Homo sapien
ttttagagacttcaactcaggattt

SEQ ID NO: 122474 - DNA, 25 bp, Homo sapien
ttttagagtaaagcaggtaaacttc

SEQ ID NO: 122475 - DNA, 25 bp, Homo sapien
ttttagagtgaagcaggtaaacttc

SEQ ID NO: 122476 - DNA, 25 bp, Homo sapien
ttttagatcaggctggttaggcaga

SEQ ID NO: 122477 - DNA, 25 bp, Homo sapien
ttttagatcaggttggttaggcaga

SEQ ID NO: 122478 - DNA, 25 bp, Homo sapien
ttttagatgaaaaacctggcatgca

SEQ ID NO: 122479 - DNA, 25 bp, Homo sapien
ttttagatgaaaaatctggcatgca

SEQ ID NO: 122480 - DNA, 25 bp, Homo sapien
ttttagcaacacggctagtaaatat

SEQ ID NO: 122481 - DNA, 25 bp, Homo sapien
ttttagcaacatggctagtaaatat

SEQ ID NO: 122482 - DNA, 25 bp, Homo sapien
ttttagcaatttaatgagtgatttc

SEQ ID NO: 122483 - DNA, 25 bp, Homo sapien
ttttagcaatttaatgcgtgatttc

SEQ ID NO: 122484 - DNA, 25 bp, Homo sapien
ttttagcacttctaaaatcattgtt

SEQ ID NO: 122485 - DNA, 25 bp, Homo sapien
ttttagcacttttaaaatcattgtt

SEQ ID NO: 122486 - DNA, 25 bp, Homo sapien
ttttagcagtacgaaacagactaat

SEQ ID NO: 122487 - DNA, 25 bp, Homo sapien
ttttagcagtatgaaacagactaat

SEQ ID NO: 122488 - DNA, 25 bp, Homo sapien
ttttagcatataccatcaggcaaaa

SEQ ID NO: 122489 - DNA, 25 bp, Homo sapien
ttttagcatatatcatcaggcaaaa

SEQ ID NO: 122490 - DNA, 25 bp, Homo sapien
ttttagccatgaaagagaatatact

SEQ ID NO: 122491 - DNA, 25 bp, Homo sapien
ttttagccatgtaagagaatatact

SEQ ID NO: 122492 - DNA, 25 bp, Homo sapien
ttttagcctcaacatcctcatctgc

SEQ ID NO: 122493 - DNA, 25 bp, Homo sapien
ttttagcctcaacatcttcatctgc

SEQ ID NO: 122494 - DNA, 25 bp, Homo sapien
ttttagccttacagaactcctatgg

SEQ ID NO: 122495 - DNA, 25 bp, Homo sapien
ttttagccttacggaactcctatgg

SEQ ID NO: 122496 - DNA, 25 bp, Homo sapien
ttttagctagagccaaacacaacaa

SEQ ID NO: 122497 - DNA, 25 bp, Homo sapien
ttttagctagaggcaaacacaacaa

SEQ ID NO: 122498 - DNA, 25 bp, Homo sapien
ttttaggatcaattgacccttgagt

SEQ ID NO: 122499 - DNA, 25 bp, Homo sapien
ttttaggatcagttgacccttgagt

SEQ ID NO: 122500 - DNA, 25 bp, Homo sapien
ttttagggtgtaattgtcacatcac

SEQ ID NO: 122501 - DNA, 25 bp, Homo sapien
ttttagggtgtacttgtcacatcac

SEQ ID NO: 122502 - DNA, 25 bp, Homo sapien
ttttaggtgttgaataaatgagtca

SEQ ID NO: 122503 - DNA, 25 bp, Homo sapien
ttttaggtgttggataaatgagtca

SEQ ID NO: 122504 - DNA, 25 bp, Homo sapien
ttttaggtttttgttacagcagtgc

SEQ ID NO: 122505 - DNA, 25 bp, Homo sapien
ttttaggtttttgttagagcagtgc

SEQ ID NO: 122506 - DNA, 25 bp, Homo sapien
ttttagtcacttgttaaaaaggtgc

SEQ ID NO: 122507 - DNA, 25 bp, Homo sapien
ttttagtcgcttgttaaaaaggtgc

SEQ ID NO: 122508 - DNA, 25 bp, Homo sapien
ttttagtgcactggttccctgacta

SEQ ID NO: 122509 - DNA, 25 bp, Homo sapien
ttttagtgcgacctggcactatgcc

SEQ ID NO: 122510 - DNA, 25 bp, Homo sapien
ttttagtgcgctggttccctgacta

SEQ ID NO: 122511 - DNA, 25 bp, Homo sapien
ttttagtggtaggtgaagtactttt

SEQ ID NO: 122512 - DNA, 25 bp, Homo sapien
ttttagtggtatgtgaagtactttt

SEQ ID NO: 122513 - DNA, 25 bp, Homo sapien
ttttagtgtgacctggcactatgcc

SEQ ID NO: 122514 - DNA, 25 bp, Homo sapien
ttttagtgtggtcatctagcttttg

SEQ ID NO: 122515 - DNA, 25 bp, Homo sapien
ttttagtgtggttatctagcttttg

SEQ ID NO: 122516 - DNA, 25 bp, Homo sapien
ttttagttatgcaatgctaccacac

SEQ ID NO: 122517 - DNA, 25 bp, Homo sapien
ttttagttatgtaatgctaccacac

SEQ ID NO: 122518 - DNA, 25 bp, Homo sapien
ttttagttgcaatgacggtgtaatt

SEQ ID NO: 122519 - DNA, 25 bp, Homo sapien
ttttagttgcaatgactgtgtaatt

SEQ ID NO: 122520 - DNA, 25 bp, Homo sapien
ttttagttgctgagcttaatcatta

SEQ ID NO: 122521 - DNA, 25 bp, Homo sapien
ttttagttgtatcattaaaaaaatg

SEQ ID NO: 122522 - DNA, 25 bp, Homo sapien
ttttagttgtatcattgaaaaaatg

SEQ ID NO: 122523 - DNA, 25 bp, Homo sapien
ttttagtttctgagcttaatcatta

SEQ ID NO: 122524 - DNA, 25 bp, Homo sapien
ttttataaatccattcactacccat

SEQ ID NO: 122525 - DNA, 25 bp, Homo sapien
ttttataaatccgttcactacccat

SEQ ID NO: 122526 - DNA, 25 bp, Homo sapien
ttttataactaacttactgacaatt

SEQ ID NO: 122527 - DNA, 25 bp, Homo sapien
ttttataactaatttactgacaatt

SEQ ID NO: 122528 - DNA, 25 bp, Homo sapien
ttttatacatgaaatgggtcctgtc

SEQ ID NO: 122529 - DNA, 25 bp, Homo sapien
ttttatacgtgaaatgggtcctgtc

SEQ ID NO: 122530 - DNA, 25 bp, Homo sapien
ttttatactcctactaacagtgcac

SEQ ID NO: 122531 - DNA, 25 bp, Homo sapien
ttttatactgctactaacagtgcac

SEQ ID NO: 122532 - DNA, 25 bp, Homo sapien
ttttatagcaacaataatagaatga

SEQ ID NO: 122533 - DNA, 25 bp, Homo sapien
ttttatagcaaccataatagaatga

SEQ ID NO: 122534 - DNA, 25 bp, Homo sapien
ttttatagcttggcggtatgtttgt

SEQ ID NO: 122535 - DNA, 25 bp, Homo sapien
ttttatagcttggtggtatgtttgt

SEQ ID NO: 122536 - DNA, 25 bp, Homo sapien
ttttatagtcctgttcattcagtcc

SEQ ID NO: 122537 - DNA, 25 bp, Homo sapien
ttttatagtcctgttcgttcagtcc

SEQ ID NO: 122538 - DNA, 25 bp, Homo sapien
ttttatagtgcacatcccctaaggc

SEQ ID NO: 122539 - DNA, 25 bp, Homo sapien
ttttatagtgcatatcccctaaggc

SEQ ID NO: 122540 - DNA, 25 bp, Homo sapien
ttttatagtgttagctcctatagga

SEQ ID NO: 122541 - DNA, 25 bp, Homo sapien
ttttatagtgttagcttctatagga

SEQ ID NO: 122542 - DNA, 25 bp, Homo sapien
ttttatagtttcagcctttagaatt

SEQ ID NO: 122543 - DNA, 25 bp, Homo sapien
ttttatagtttcaggctttagaatt

SEQ ID NO: 122544 - DNA, 25 bp, Homo sapien
ttttatatagtcaatatccgtgtag

SEQ ID NO: 122545 - DNA, 25 bp, Homo sapien
ttttatatagtcgatatccgtgtag

SEQ ID NO: 122546 - DNA, 25 bp, Homo sapien
ttttatatatgccttcaagcttgat

SEQ ID NO: 122547 - DNA, 25 bp, Homo sapien
ttttatatatggcttcaagcttgat

SEQ ID NO: 122548 - DNA, 25 bp, Homo sapien
ttttatatatttctcacttaccttt

SEQ ID NO: 122549 - DNA, 25 bp, Homo sapien
ttttatatatttgtcacttaccttt

SEQ ID NO: 122550 - DNA, 25 bp, Homo sapien
ttttatatccaaacaagtcaagcta

SEQ ID NO: 122551 - DNA, 25 bp, Homo sapien
ttttatatccaagcaagtcaagcta

SEQ ID NO: 122552 - DNA, 25 bp, Homo sapien
ttttatatgacacgagaaaaaatgg

SEQ ID NO: 122553 - DNA, 25 bp, Homo sapien
ttttatatgacatgagaaaaaatgg

SEQ ID NO: 122554 - DNA, 25 bp, Homo sapien
ttttatcaagggccatttctgtgta

SEQ ID NO: 122555 - DNA, 25 bp, Homo sapien
ttttatcaagggctatttctgtgta

SEQ ID NO: 122556 - DNA, 25 bp, Homo sapien
ttttatcattacggcatcatcgtca

SEQ ID NO: 122557 - DNA, 25 bp, Homo sapien
ttttatcattatggcatcatcgtca

SEQ ID NO: 122558 - DNA, 25 bp, Homo sapien
ttttatcattcacctaaagacccac

SEQ ID NO: 122559 - DNA, 25 bp, Homo sapien
ttttatcattcatctaaagacccac

SEQ ID NO: 122560 - DNA, 25 bp, Homo sapien
ttttatccaacaaagtataaagtta

SEQ ID NO: 122561 - DNA, 25 bp, Homo sapien
ttttatccacgctttactgcacaca

SEQ ID NO: 122562 - DNA, 25 bp, Homo sapien
ttttatccagaggcgtggacttagt

SEQ ID NO: 122563 - DNA, 25 bp, Homo sapien
ttttatccagaggtgtggacttagt

SEQ ID NO: 122564 - DNA, 25 bp, Homo sapien
ttttatccagtgttaaggcttacta

SEQ ID NO: 122565 - DNA, 25 bp, Homo sapien
ttttatccatcaaagtataaagtta

SEQ ID NO: 122566 - DNA, 25 bp, Homo sapien
ttttatccatcttccttcatttgtt

SEQ ID NO: 122567 - DNA, 25 bp, Homo sapien
ttttatccatgctttactgcacaca

SEQ ID NO: 122568 - DNA, 25 bp, Homo sapien
ttttatccggtgttaaggcttacta

SEQ ID NO: 122569 - DNA, 25 bp, Homo sapien
ttttatcctcttgttcttccacaga

SEQ ID NO: 122570 - DNA, 25 bp, Homo sapien
ttttatcctctttttcttccacaga

SEQ ID NO: 122571 - DNA, 25 bp, Homo sapien
ttttatcctgagatatacactgttt

SEQ ID NO: 122572 - DNA, 25 bp, Homo sapien
ttttatcctgagatattcactgttt

SEQ ID NO: 122573 - DNA, 25 bp, Homo sapien
ttttatccttcttccttcatttgtt

SEQ ID NO: 122574 - DNA, 25 bp, Homo sapien
ttttatctcaagtgaacctggagaa

SEQ ID NO: 122575 - DNA, 25 bp, Homo sapien
ttttatctcaagtgaatctggagaa

SEQ ID NO: 122576 - DNA, 25 bp, Homo sapien
ttttatctcctttgagcaacatctc

SEQ ID NO: 122577 - DNA, 25 bp, Homo sapien
ttttatctcggtgaactacctgagt

SEQ ID NO: 122578 - DNA, 25 bp, Homo sapien
ttttatctgctttgagcaacatctc

SEQ ID NO: 122579 - DNA, 25 bp, Homo sapien
ttttatcttggtgaactacctgagt

SEQ ID NO: 122580 - DNA, 25 bp, Homo sapien
ttttatgagcgcatgatatctgcta

SEQ ID NO: 122581 - DNA, 25 bp, Homo sapien
ttttatgagtgcatgatatctgcta

SEQ ID NO: 122582 - DNA, 25 bp, Homo sapien
ttttatgatctgagtattcactgga

SEQ ID NO: 122583 - DNA, 25 bp, Homo sapien
ttttatgatctgtgtattcactgga

SEQ ID NO: 122584 - DNA, 25 bp, Homo sapien
ttttatgccttgacctttgtaccca

SEQ ID NO: 122585 - DNA, 25 bp, Homo sapien
ttttatgcgttgacctttgtaccca

SEQ ID NO: 122586 - DNA, 25 bp, Homo sapien
ttttatgcttttgatccttcccata

SEQ ID NO: 122587 - DNA, 25 bp, Homo sapien
ttttatgcttttggtccttcccata

SEQ ID NO: 122588 - DNA, 25 bp, Homo sapien
ttttatggctgcagtatttaaacag

SEQ ID NO: 122589 - DNA, 25 bp, Homo sapien
ttttatggctgtacgctgaaatgat

SEQ ID NO: 122590 - DNA, 25 bp, Homo sapien
ttttatggctgtatgctgaaatgat

SEQ ID NO: 122591 - DNA, 25 bp, Homo sapien
ttttatggtaaaagcaatgtaggct

SEQ ID NO: 122592 - DNA, 25 bp, Homo sapien
ttttatggtaaaggcaatgtaggct

SEQ ID NO: 122593 - DNA, 25 bp, Homo sapien
ttttatggttgcagtatttaaacag

SEQ ID NO: 122594 - DNA, 25 bp, Homo sapien
ttttatgttagaccattctggcagc

SEQ ID NO: 122595 - DNA, 25 bp, Homo sapien
ttttatgttagaccgttctggcagc

SEQ ID NO: 122596 - DNA, 25 bp, Homo sapien
ttttattaccagtgaatagtgtaag

SEQ ID NO: 122597 - DNA, 25 bp, Homo sapien
ttttattataagccataggtacaga

SEQ ID NO: 122598 - DNA, 25 bp, Homo sapien
ttttattataagtcataggtacaga

SEQ ID NO: 122599 - DNA, 25 bp, Homo sapien
ttttattatcagtgaatagtgtaag

SEQ ID NO: 122600 - DNA, 25 bp, Homo sapien
ttttattatgtgatttttcctgctt

SEQ ID NO: 122601 - DNA, 25 bp, Homo sapien
ttttattatgtggtttttcctgctt

SEQ ID NO: 122602 - DNA, 25 bp, Homo sapien
ttttattcaacgggttcacaagttt

SEQ ID NO: 122603 - DNA, 25 bp, Homo sapien
ttttattcaacgtgttcacaagttt

SEQ ID NO: 122604 - DNA, 25 bp, Homo sapien
ttttattcacatcagttgttttgca

SEQ ID NO: 122605 - DNA, 25 bp, Homo sapien
ttttattcacgttctcggtggcgta

SEQ ID NO: 122606 - DNA, 25 bp, Homo sapien
ttttattcactcatatcgaattggg

SEQ ID NO: 122607 - DNA, 25 bp, Homo sapien
ttttattcactcgtatcgaattggg

SEQ ID NO: 122608 - DNA, 25 bp, Homo sapien
ttttattcatgttctcggtggcgta

SEQ ID NO: 122609 - DNA, 25 bp, Homo sapien
ttttattcgcatcagttgttttgca

SEQ ID NO: 122610 - DNA, 25 bp, Homo sapien
ttttattcgctgcttcatctcccct

SEQ ID NO: 122611 - DNA, 25 bp, Homo sapien
ttttattcgctgtttcatctcccct

SEQ ID NO: 122612 - DNA, 25 bp, Homo sapien
ttttattcgggtacttgttgcttta

SEQ ID NO: 122613 - DNA, 25 bp, Homo sapien
ttttattcgggtgcttgttgcttta

SEQ ID NO: 122614 - DNA, 25 bp, Homo sapien
ttttattgacatatactccttctct

SEQ ID NO: 122615 - DNA, 25 bp, Homo sapien
ttttattgacatctactccttctct

SEQ ID NO: 122616 - DNA, 25 bp, Homo sapien
ttttattgcaatgaatcttctcatt

SEQ ID NO: 122617 - DNA, 25 bp, Homo sapien
ttttattgcaattaatcttctcatt

SEQ ID NO: 122618 - DNA, 25 bp, Homo sapien
ttttattggaacacactatgtaatg

SEQ ID NO: 122619 - DNA, 25 bp, Homo sapien
ttttattggaagacactatgtaatg

SEQ ID NO: 122620 - DNA, 25 bp, Homo sapien
ttttattggccatctctctgactgg

SEQ ID NO: 122621 - DNA, 25 bp, Homo sapien
ttttattggccgtctctctgactgg

SEQ ID NO: 122622 - DNA, 25 bp, Homo sapien
ttttattgtattgcaatttcctggc

SEQ ID NO: 122623 - DNA, 25 bp, Homo sapien
ttttattgtattgccatttcctggc

SEQ ID NO: 122624 - DNA, 25 bp, Homo sapien
ttttattgtggttgtgaccatgccc

SEQ ID NO: 122625 - DNA, 25 bp, Homo sapien
ttttattgtggttgtgtccatgccc

SEQ ID NO: 122626 - DNA, 25 bp, Homo sapien
ttttatttaatgcttggtattatgt

SEQ ID NO: 122627 - DNA, 25 bp, Homo sapien
ttttatttaatgtttggtattatgt

SEQ ID NO: 122628 - DNA, 25 bp, Homo sapien
ttttatttatccgacatttttcttt

SEQ ID NO: 122629 - DNA, 25 bp, Homo sapien
ttttatttatctgacatttttcttt

SEQ ID NO: 122630 - DNA, 25 bp, Homo sapien
ttttatttattgcagtatatttttg

SEQ ID NO: 122631 - DNA, 25 bp, Homo sapien
ttttatttattggagtatatttttg

SEQ ID NO: 122632 - DNA, 25 bp, Homo sapien
ttttatttccctcctatgttgattc

SEQ ID NO: 122633 - DNA, 25 bp, Homo sapien
ttttatttcgtctctacaggctgct

SEQ ID NO: 122634 - DNA, 25 bp, Homo sapien
ttttatttcttctctacaggctgct

SEQ ID NO: 122635 - DNA, 25 bp, Homo sapien
ttttatttgtaacttttatgagtta

SEQ ID NO: 122636 - DNA, 25 bp, Homo sapien
ttttatttgtaatttttatgagtta

SEQ ID NO: 122637 - DNA, 25 bp, Homo sapien
ttttatttgtacactgggcctttgc

SEQ ID NO: 122638 - DNA, 25 bp, Homo sapien
ttttatttgtagactgggcctttgc

SEQ ID NO: 122639 - DNA, 25 bp, Homo sapien
ttttattttaagctaacatacacaa

SEQ ID NO: 122640 - DNA, 25 bp, Homo sapien
ttttattttaaggtaacatacacaa

SEQ ID NO: 122641 - DNA, 25 bp, Homo sapien
ttttattttcctcctatgttgattc

SEQ ID NO: 122642 - DNA, 25 bp, Homo sapien
ttttattttgacgaatctccaaagg

SEQ ID NO: 122643 - DNA, 25 bp, Homo sapien
ttttattttgatgaatctccaaagg

SEQ ID NO: 122644 - DNA, 25 bp, Homo sapien
ttttatttttttgcagagatggctt

SEQ ID NO: 122645 - DNA, 25 bp, Homo sapien
ttttatttttttgccgagatggctt

SEQ ID NO: 122646 - DNA, 25 bp, Homo sapien
ttttcaaaacacaaaagtataaagt

SEQ ID NO: 122647 - DNA, 25 bp, Homo sapien
ttttcaaaacataaaagtataaagt

SEQ ID NO: 122648 - DNA, 25 bp, Homo sapien
ttttcaaaatcaactatttcaagtg

SEQ ID NO: 122649 - DNA, 25 bp, Homo sapien
ttttcaaaatcactacagctgtccc

SEQ ID NO: 122650 - DNA, 25 bp, Homo sapien
ttttcaaaatcagctatttcaagtg

SEQ ID NO: 122651 - DNA, 25 bp, Homo sapien
ttttcaaaatgccctttgcaatgat

SEQ ID NO: 122652 - DNA, 25 bp, Homo sapien
ttttcaaaatgtcctttgcaatgat

SEQ ID NO: 122653 - DNA, 25 bp, Homo sapien
ttttcaaaattcagtaacttgccca

SEQ ID NO: 122654 - DNA, 25 bp, Homo sapien
ttttcaaacattatcaaaatgaaac

SEQ ID NO: 122655 - DNA, 25 bp, Homo sapien
ttttcaaactttatcaaaatgaaac

SEQ ID NO: 122656 - DNA, 25 bp, Homo sapien
ttttcaaaggagcagcaccatcctc

SEQ ID NO: 122657 - DNA, 25 bp, Homo sapien
ttttcaaaggagcggcaccatcctc

SEQ ID NO: 122658 - DNA, 25 bp, Homo sapien
ttttcaaagttcagtaacttgccca

SEQ ID NO: 122659 - DNA, 25 bp, Homo sapien
ttttcaaataatgccaggaaatgca

SEQ ID NO: 122660 - DNA, 25 bp, Homo sapien
ttttcaaataatgtcaggaaatgca

SEQ ID NO: 122661 - DNA, 25 bp, Homo sapien
ttttcaaattcactacagctgtccc

SEQ ID NO: 122662 - DNA, 25 bp, Homo sapien
ttttcaactatgtgtttaaatctgg

SEQ ID NO: 122663 - DNA, 25 bp, Homo sapien
ttttcaactgtgtgtttaaatctgg

SEQ ID NO: 122664 - DNA, 25 bp, Homo sapien
ttttcaagaaagtaatttaccaagt

SEQ ID NO: 122665 - DNA, 25 bp, Homo sapien
ttttcaagacagtaatttaccaagt

SEQ ID NO: 122666 - DNA, 25 bp, Homo sapien
ttttcaagactcaacacactttgct

SEQ ID NO: 122667 - DNA, 25 bp, Homo sapien
ttttcaagcacttcaaacttcataa

SEQ ID NO: 122668 - DNA, 25 bp, Homo sapien
ttttcaagcactttaaacttcataa

SEQ ID NO: 122669 - DNA, 25 bp, Homo sapien
ttttcaaggctcaacacactttgct

SEQ ID NO: 122670 - DNA, 25 bp, Homo sapien
ttttcaatagctaatttttactcac

SEQ ID NO: 122671 - DNA, 25 bp, Homo sapien
ttttcaatagctattttttactcac

SEQ ID NO: 122672 - DNA, 25 bp, Homo sapien
ttttcaattcatgcttcgttgaatc

SEQ ID NO: 122673 - DNA, 25 bp, Homo sapien
ttttcaattcatgcttggttgaatc

SEQ ID NO: 122674 - DNA, 25 bp, Homo sapien
ttttcacaaataacataaacaagtt

SEQ ID NO: 122675 - DNA, 25 bp, Homo sapien
ttttcacaaataagataaacaagtt

SEQ ID NO: 122676 - DNA, 25 bp, Homo sapien
ttttcacaacttacatcggttttca

SEQ ID NO: 122677 - DNA, 25 bp, Homo sapien
ttttcacaacttacattggttttca

SEQ ID NO: 122678 - DNA, 25 bp, Homo sapien
ttttcacataatgtaccattccatt

SEQ ID NO: 122679 - DNA, 25 bp, Homo sapien
ttttcacataatgtactattccatt

SEQ ID NO: 122680 - DNA, 25 bp, Homo sapien
ttttcacatacaacgctttgataaa

SEQ ID NO: 122681 - DNA, 25 bp, Homo sapien
ttttcacatacaatgctttgataaa

SEQ ID NO: 122682 - DNA, 25 bp, Homo sapien
ttttcacatatgcatatacccctgt

SEQ ID NO: 122683 - DNA, 25 bp, Homo sapien
ttttcacatcggtcactttaaaaaa

SEQ ID NO: 122684 - DNA, 25 bp, Homo sapien
ttttcacatgtgcatatacccctgt

SEQ ID NO: 122685 - DNA, 25 bp, Homo sapien
ttttcacattggtcactttaaaaaa

SEQ ID NO: 122686 - DNA, 25 bp, Homo sapien
ttttcacatttccgacaaagttctt

SEQ ID NO: 122687 - DNA, 25 bp, Homo sapien
ttttcacatttccggcaaagttctt

SEQ ID NO: 122688 - DNA, 25 bp, Homo sapien
ttttcacctaaagttcaatttaaga

SEQ ID NO: 122689 - DNA, 25 bp, Homo sapien
ttttcacctaaagttctatttaaga

SEQ ID NO: 122690 - DNA, 25 bp, Homo sapien
ttttcacctaataaacctgtcctac

SEQ ID NO: 122691 - DNA, 25 bp, Homo sapien
ttttcacctaataagcctgtcctac

SEQ ID NO: 122692 - DNA, 25 bp, Homo sapien
ttttcacctttaatcaacagcatac

SEQ ID NO: 122693 - DNA, 25 bp, Homo sapien
ttttcacctttagtcaacagcatac

SEQ ID NO: 122694 - DNA, 25 bp, Homo sapien
ttttcacgctaaaactgagattctt

SEQ ID NO: 122695 - DNA, 25 bp, Homo sapien
ttttcacgctaaaattgagattctt

SEQ ID NO: 122696 - DNA, 25 bp, Homo sapien
ttttcacgggtgtaggttttctcat

SEQ ID NO: 122697 - DNA, 25 bp, Homo sapien
ttttcacgggtttaggttttctcat

SEQ ID NO: 122698 - DNA, 25 bp, Homo sapien
ttttcacgtgatcaagcatcatagt

SEQ ID NO: 122699 - DNA, 25 bp, Homo sapien
ttttcacgtgatcaagtatcatagt

SEQ ID NO: 122700 - DNA, 25 bp, Homo sapien
ttttcacttacagtacggtagtcaa

SEQ ID NO: 122701 - DNA, 25 bp, Homo sapien
ttttcacttcctattggagtctttt

SEQ ID NO: 122702 - DNA, 25 bp, Homo sapien
ttttcacttcctgttggagtctttt

SEQ ID NO: 122703 - DNA, 25 bp, Homo sapien
ttttcactttcagtacggtagtcaa

SEQ ID NO: 122704 - DNA, 25 bp, Homo sapien
ttttcactttgaatatctaggtaga

SEQ ID NO: 122705 - DNA, 25 bp, Homo sapien
ttttcactttggatatctaggtaga

SEQ ID NO: 122706 - DNA, 25 bp, Homo sapien
ttttcacttttaaggagtttctgta

SEQ ID NO: 122707 - DNA, 25 bp, Homo sapien
ttttcacttttaagtagtttctgta

SEQ ID NO: 122708 - DNA, 25 bp, Homo sapien
ttttcagaaagacagaacagagaaa

SEQ ID NO: 122709 - DNA, 25 bp, Homo sapien
ttttcagaaagacggaacagagaaa

SEQ ID NO: 122710 - DNA, 25 bp, Homo sapien
ttttcagaaagcagtaccttttcca

SEQ ID NO: 122711 - DNA, 25 bp, Homo sapien
ttttcagaaagcattaccttttcca

SEQ ID NO: 122712 - DNA, 25 bp, Homo sapien
ttttcagcagtcattttcttcaatt

SEQ ID NO: 122713 - DNA, 25 bp, Homo sapien
ttttcagcagtctttttcttcaatt

SEQ ID NO: 122714 - DNA, 25 bp, Homo sapien
ttttcagcatctgtgagattatttc

SEQ ID NO: 122715 - DNA, 25 bp, Homo sapien
ttttcagcatctttgagattatttc

SEQ ID NO: 122716 - DNA, 25 bp, Homo sapien
ttttcagctgcttctggctataggt

SEQ ID NO: 122717 - DNA, 25 bp, Homo sapien
ttttcagcttcttctggctataggt

SEQ ID NO: 122718 - DNA, 25 bp, Homo sapien
ttttcaggattccctggtattttta

SEQ ID NO: 122719 - DNA, 25 bp, Homo sapien
ttttcaggattccttggtattttta

SEQ ID NO: 122720 - DNA, 25 bp, Homo sapien
ttttcaggcagcgaaaaagttctaa

SEQ ID NO: 122721 - DNA, 25 bp, Homo sapien
ttttcaggcagtgaaaaagttctaa

SEQ ID NO: 122722 - DNA, 25 bp, Homo sapien
ttttcaggctccttaagtctcatat

SEQ ID NO: 122723 - DNA, 25 bp, Homo sapien
ttttcaggctcgttaagtctcatat

SEQ ID NO: 122724 - DNA, 25 bp, Homo sapien
ttttcaggtgttcactagttcctat

SEQ ID NO: 122725 - DNA, 25 bp, Homo sapien
ttttcaggtgttcgctagttcctat

SEQ ID NO: 122726 - DNA, 25 bp, Homo sapien
ttttcagttacattaacggctcaaa

SEQ ID NO: 122727 - DNA, 25 bp, Homo sapien
ttttcagttacattgacggctcaaa

SEQ ID NO: 122728 - DNA, 25 bp, Homo sapien
ttttcagtttaatagctgagaaata

SEQ ID NO: 122729 - DNA, 25 bp, Homo sapien
ttttcagtttaatggctgagaaata

SEQ ID NO: 122730 - DNA, 25 bp, Homo sapien
ttttcataacttagtcatatttctc

SEQ ID NO: 122731 - DNA, 25 bp, Homo sapien
ttttcataacttagtcgtatttctc

SEQ ID NO: 122732 - DNA, 25 bp, Homo sapien
ttttcataagactcgcccaccaatg

SEQ ID NO: 122733 - DNA, 25 bp, Homo sapien
ttttcataagattcgcccaccaatg

SEQ ID NO: 122734 - DNA, 25 bp, Homo sapien
ttttcataccctgctctcaaataca

SEQ ID NO: 122735 - DNA, 25 bp, Homo sapien
ttttcatacgctgctctcaaataca

SEQ ID NO: 122736 - DNA, 25 bp, Homo sapien
ttttcatagtaaccattgcattttt

SEQ ID NO: 122737 - DNA, 25 bp, Homo sapien
ttttcatagtaaccgttgcattttt

SEQ ID NO: 122738 - DNA, 25 bp, Homo sapien
ttttcatatgctcacatgacatctg

SEQ ID NO: 122739 - DNA, 25 bp, Homo sapien
ttttcatatgcttacatgacatctg

SEQ ID NO: 122740 - DNA, 25 bp, Homo sapien
ttttcatcaattaggtttttttgtt

SEQ ID NO: 122741 - DNA, 25 bp, Homo sapien
ttttcatcaattagttttttttgtt

SEQ ID NO: 122742 - DNA, 25 bp, Homo sapien
ttttcatcatcacatttgtcaccat

SEQ ID NO: 122743 - DNA, 25 bp, Homo sapien
ttttcatcatcacgtttgtcaccat

SEQ ID NO: 122744 - DNA, 25 bp, Homo sapien
ttttcatcccacaaattcgaatctt

SEQ ID NO: 122745 - DNA, 25 bp, Homo sapien
ttttcatcctacaaattcgaatctt

SEQ ID NO: 122746 - DNA, 25 bp, Homo sapien
ttttcatctacaaatggaacaatct

SEQ ID NO: 122747 - DNA, 25 bp, Homo sapien
ttttcatctacgaatggaacaatct

SEQ ID NO: 122748 - DNA, 25 bp, Homo sapien
ttttcatgacgaactttgaggataa

SEQ ID NO: 122749 - DNA, 25 bp, Homo sapien
ttttcatgactgcaatgactgctcc

SEQ ID NO: 122750 - DNA, 25 bp, Homo sapien
ttttcatgactggaatgactgctcc

SEQ ID NO: 122751 - DNA, 25 bp, Homo sapien
ttttcatgatgaactttgaggataa

SEQ ID NO: 122752 - DNA, 25 bp, Homo sapien
ttttcatgcagtctaaagataaaat

SEQ ID NO: 122753 - DNA, 25 bp, Homo sapien
ttttcatgcagtctaaggataaaat

SEQ ID NO: 122754 - DNA, 25 bp, Homo sapien
ttttcatggaagataagttgaaaga

SEQ ID NO: 122755 - DNA, 25 bp, Homo sapien
ttttcatggctttttatcatttgtt

SEQ ID NO: 122756 - DNA, 25 bp, Homo sapien
ttttcatgggagataagttgaaaga

SEQ ID NO: 122757 - DNA, 25 bp, Homo sapien
ttttcatggttttttatcatttgtt

SEQ ID NO: 122758 - DNA, 25 bp, Homo sapien
ttttcattcaccaagccaactgtga

SEQ ID NO: 122759 - DNA, 25 bp, Homo sapien
ttttcattcaccgagccaactgtga

SEQ ID NO: 122760 - DNA, 25 bp, Homo sapien
ttttcattcgctttgttgaagatga

SEQ ID NO: 122761 - DNA, 25 bp, Homo sapien
ttttcattctagacagagaagttga

SEQ ID NO: 122762 - DNA, 25 bp, Homo sapien
ttttcattctagacagcgaagttga

SEQ ID NO: 122763 - DNA, 25 bp, Homo sapien
ttttcatttgctttgttgaagatga

SEQ ID NO: 122764 - DNA, 25 bp, Homo sapien
ttttcatttgtctcaaggaattttt

SEQ ID NO: 122765 - DNA, 25 bp, Homo sapien
ttttcatttgtctcgaggaattttt

SEQ ID NO: 122766 - DNA, 25 bp, Homo sapien
ttttccaaaacgcgtaaatcatcta

SEQ ID NO: 122767 - DNA, 25 bp, Homo sapien
ttttccaaaacgtgtaaatcatcta

SEQ ID NO: 122768 - DNA, 25 bp, Homo sapien
ttttccaaaaggtcatatcatactg

SEQ ID NO: 122769 - DNA, 25 bp, Homo sapien
ttttccaaaaggtcgtatcatactg

SEQ ID NO: 122770 - DNA, 25 bp, Homo sapien
ttttccaaacttattgtactaccag

SEQ ID NO: 122771 - DNA, 25 bp, Homo sapien
ttttccaaagacgatttattgaaaa

SEQ ID NO: 122772 - DNA, 25 bp, Homo sapien
ttttccaaagatgatttattgaaaa

SEQ ID NO: 122773 - DNA, 25 bp, Homo sapien
ttttccaaatggctcacggttggag

SEQ ID NO: 122774 - DNA, 25 bp, Homo sapien
ttttccaaatggctcatggttggag

SEQ ID NO: 122775 - DNA, 25 bp, Homo sapien
ttttccaaatttattgtactaccag

SEQ ID NO: 122776 - DNA, 25 bp, Homo sapien
ttttccaaggagacagtggatggct

SEQ ID NO: 122777 - DNA, 25 bp, Homo sapien
ttttccaaggagagagtggatggct

SEQ ID NO: 122778 - DNA, 25 bp, Homo sapien
ttttccacaactccccttctaatca

SEQ ID NO: 122779 - DNA, 25 bp, Homo sapien
ttttccacaacttcccttctaatca

SEQ ID NO: 122780 - DNA, 25 bp, Homo sapien
ttttccacaaggcttgcaattttac

SEQ ID NO: 122781 - DNA, 25 bp, Homo sapien
ttttccacgaggcttgcaattttac

SEQ ID NO: 122782 - DNA, 25 bp, Homo sapien
ttttccactgaacgatctttttatc

SEQ ID NO: 122783 - DNA, 25 bp, Homo sapien
ttttccactgaatgatctttttatc

SEQ ID NO: 122784 - DNA, 25 bp, Homo sapien
ttttccatgaacacgatatttttgt

SEQ ID NO: 122785 - DNA, 25 bp, Homo sapien
ttttccatgaacactatatttttgt

SEQ ID NO: 122786 - DNA, 25 bp, Homo sapien
ttttccatgagagagaaaaaaacag

SEQ ID NO: 122787 - DNA, 25 bp, Homo sapien
ttttccatgggagagaaaaaaacag

SEQ ID NO: 122788 - DNA, 25 bp, Homo sapien
ttttcccaatttgcgtttttatttg

SEQ ID NO: 122789 - DNA, 25 bp, Homo sapien
ttttcccaatttgtgtttttatttg

SEQ ID NO: 122790 - DNA, 25 bp, Homo sapien
ttttcccagactatttttgacctat

SEQ ID NO: 122791 - DNA, 25 bp, Homo sapien
ttttcccaggctatttttgacctat

SEQ ID NO: 122792 - DNA, 25 bp, Homo sapien
ttttccccataagtgcaatattctc

SEQ ID NO: 122793 - DNA, 25 bp, Homo sapien
ttttccccataagtgcgatattctc

SEQ ID NO: 122794 - DNA, 25 bp, Homo sapien
ttttcccgattatctctgtttcatg

SEQ ID NO: 122795 - DNA, 25 bp, Homo sapien
ttttcccgattatgtctgtttcatg

SEQ ID NO: 122796 - DNA, 25 bp, Homo sapien
ttttccctacagaatgattgagtct

SEQ ID NO: 122797 - DNA, 25 bp, Homo sapien
ttttccctgcctgacatactttggc

SEQ ID NO: 122798 - DNA, 25 bp, Homo sapien
ttttcccttcagaatgattgagtct

SEQ ID NO: 122799 - DNA, 25 bp, Homo sapien
ttttcccttcctgacatactttggc

SEQ ID NO: 122800 - DNA, 25 bp, Homo sapien
ttttccggatatcagcaccaactaa

SEQ ID NO: 122801 - DNA, 25 bp, Homo sapien
ttttccggatatcagctccaactaa

SEQ ID NO: 122802 - DNA, 25 bp, Homo sapien
ttttcctaatttatattgcacttac

SEQ ID NO: 122803 - DNA, 25 bp, Homo sapien
ttttcctaatttatgttgcacttac

SEQ ID NO: 122804 - DNA, 25 bp, Homo sapien
ttttcctacttaatttctgtatgat

SEQ ID NO: 122805 - DNA, 25 bp, Homo sapien
ttttcctacttattttctgtatgat

SEQ ID NO: 122806 - DNA, 25 bp, Homo sapien
ttttcctcaaacagttcctgctaat

SEQ ID NO: 122807 - DNA, 25 bp, Homo sapien
ttttcctcaaacatttcctgctaat

SEQ ID NO: 122808 - DNA, 25 bp, Homo sapien
ttttcctccagccaacaacccccag

SEQ ID NO: 122809 - DNA, 25 bp, Homo sapien
ttttcctccggccaacaacccccag

SEQ ID NO: 122810 - DNA, 25 bp, Homo sapien
ttttcctctggcgtgacttcatctt

SEQ ID NO: 122811 - DNA, 25 bp, Homo sapien
ttttcctctggcgtgagttcatctt

SEQ ID NO: 122812 - DNA, 25 bp, Homo sapien
ttttcctgaacaaacacctctgagc

SEQ ID NO: 122813 - DNA, 25 bp, Homo sapien
ttttcctgaactatacatggtagga

SEQ ID NO: 122814 - DNA, 25 bp, Homo sapien
ttttcctgaactatacgtggtagga

SEQ ID NO: 122815 - DNA, 25 bp, Homo sapien
ttttcctgagcaaacacctctgagc

SEQ ID NO: 122816 - DNA, 25 bp, Homo sapien
ttttcctgaggcacctgtttggaat

SEQ ID NO: 122817 - DNA, 25 bp, Homo sapien
ttttcctgaggcgcctgtttggaat

SEQ ID NO: 122818 - DNA, 25 bp, Homo sapien
ttttcctgcctccttatttgactgt

SEQ ID NO: 122819 - DNA, 25 bp, Homo sapien
ttttcctgcctgcttatttgactgt

SEQ ID NO: 122820 - DNA, 25 bp, Homo sapien
ttttcctggatggtaccgatgcttg

SEQ ID NO: 122821 - DNA, 25 bp, Homo sapien
ttttcctggatggtactgatgcttg

SEQ ID NO: 122822 - DNA, 25 bp, Homo sapien
ttttcctggcagctgtccattccgg

SEQ ID NO: 122823 - DNA, 25 bp, Homo sapien
ttttcctggcagttgtccattccgg

SEQ ID NO: 122824 - DNA, 25 bp, Homo sapien
ttttcctgtgagcttgcattgccca

SEQ ID NO: 122825 - DNA, 25 bp, Homo sapien
ttttcctgtgatcttgcattgccca

SEQ ID NO: 122826 - DNA, 25 bp, Homo sapien
ttttcctgtgccaaatttttatgtg

SEQ ID NO: 122827 - DNA, 25 bp, Homo sapien
ttttcctgtgctaaatttttatgtg

SEQ ID NO: 122828 - DNA, 25 bp, Homo sapien
ttttccttcatcagcatatatgcaa

SEQ ID NO: 122829 - DNA, 25 bp, Homo sapien
ttttccttcatcggcatatatgcaa

SEQ ID NO: 122830 - DNA, 25 bp, Homo sapien
ttttccttgacacgctaccgctaga

SEQ ID NO: 122831 - DNA, 25 bp, Homo sapien
ttttccttgacatgctaccgctaga

SEQ ID NO: 122832 - DNA, 25 bp, Homo sapien
ttttccttgagtaatgaatgcaatg

SEQ ID NO: 122833 - DNA, 25 bp, Homo sapien
ttttccttgggtaatgaatgcaatg

SEQ ID NO: 122834 - DNA, 25 bp, Homo sapien
ttttcctttagctaaagcctattct

SEQ ID NO: 122835 - DNA, 25 bp, Homo sapien
ttttcctttagctaaatcctattct

SEQ ID NO: 122836 - DNA, 25 bp, Homo sapien
ttttcctttctcagccgtcttctac

SEQ ID NO: 122837 - DNA, 25 bp, Homo sapien
ttttcctttctcagtcgtcttctac

SEQ ID NO: 122838 - DNA, 25 bp, Homo sapien
ttttcggcttcatagacatcttggc

SEQ ID NO: 122839 - DNA, 25 bp, Homo sapien
ttttcggcttcattgacatcttggc

SEQ ID NO: 122840 - DNA, 25 bp, Homo sapien
ttttcggtttggcatagcacattgt

SEQ ID NO: 122841 - DNA, 25 bp, Homo sapien
ttttcggtttggcgtagcacattgt

SEQ ID NO: 122842 - DNA, 25 bp, Homo sapien
ttttcgtgcaccgctgacatgcacc

SEQ ID NO: 122843 - DNA, 25 bp, Homo sapien
ttttcgtgcactgctgacatgcacc

SEQ ID NO: 122844 - DNA, 25 bp, Homo sapien
ttttcgtgggacgagagcagaggga

SEQ ID NO: 122845 - DNA, 25 bp, Homo sapien
ttttcgtgggatgagagcagaggga

SEQ ID NO: 122846 - DNA, 25 bp, Homo sapien
ttttctaaaatccttgaaagatccc

SEQ ID NO: 122847 - DNA, 25 bp, Homo sapien
ttttctaaaatccttggaagatccc

SEQ ID NO: 122848 - DNA, 25 bp, Homo sapien
ttttctaaacaacccttccatgtcc

SEQ ID NO: 122849 - DNA, 25 bp, Homo sapien
ttttctaaacaacctttccatgtcc

SEQ ID NO: 122850 - DNA, 25 bp, Homo sapien
ttttctaaagaattaatgtacagag

SEQ ID NO: 122851 - DNA, 25 bp, Homo sapien
ttttctaaagagttaatgtacagag

SEQ ID NO: 122852 - DNA, 25 bp, Homo sapien
ttttctacaactcccgagtccactc

SEQ ID NO: 122853 - DNA, 25 bp, Homo sapien
ttttctacaacttacactacaccaa

SEQ ID NO: 122854 - DNA, 25 bp, Homo sapien
ttttctacacctcccgagtccactc

SEQ ID NO: 122855 - DNA, 25 bp, Homo sapien
ttttctacaccttacactacaccaa

SEQ ID NO: 122856 - DNA, 25 bp, Homo sapien
ttttctacattatcctccttagtgc

SEQ ID NO: 122857 - DNA, 25 bp, Homo sapien
ttttctacattgtcctccttagtgc

SEQ ID NO: 122858 - DNA, 25 bp, Homo sapien
ttttctaccaatcaacgaagtgcca

SEQ ID NO: 122859 - DNA, 25 bp, Homo sapien
ttttctaccgatcaacgaagtgcca

SEQ ID NO: 122860 - DNA, 25 bp, Homo sapien
ttttctactgaaagacactgaaata

SEQ ID NO: 122861 - DNA, 25 bp, Homo sapien
ttttctactgaaaggcactgaaata

SEQ ID NO: 122862 - DNA, 25 bp, Homo sapien
ttttctatagttactgaacattgaa

SEQ ID NO: 122863 - DNA, 25 bp, Homo sapien
ttttctatagttattgaacattgaa

SEQ ID NO: 122864 - DNA, 25 bp, Homo sapien
ttttctatcaccattgcaaacctga

SEQ ID NO: 122865 - DNA, 25 bp, Homo sapien
ttttctatcaccgttgcaaacctga

SEQ ID NO: 122866 - DNA, 25 bp, Homo sapien
ttttctatgtgagggactaaaaaaa

SEQ ID NO: 122867 - DNA, 25 bp, Homo sapien
ttttctatgtgagggattaaaaaaa

SEQ ID NO: 122868 - DNA, 25 bp, Homo sapien
ttttctattccttttggagttgttt

SEQ ID NO: 122869 - DNA, 25 bp, Homo sapien
ttttctatttcttttggagttgttt

SEQ ID NO: 122870 - DNA, 25 bp, Homo sapien
ttttctattttacgcagcaggttta

SEQ ID NO: 122871 - DNA, 25 bp, Homo sapien
ttttctattttatgcagcaggttta

SEQ ID NO: 122872 - DNA, 25 bp, Homo sapien
ttttctcaagaacctgggtttctcc

SEQ ID NO: 122873 - DNA, 25 bp, Homo sapien
ttttctcaagatcctgggtttctcc

SEQ ID NO: 122874 - DNA, 25 bp, Homo sapien
ttttctcaatcttcaaatgagtctg

SEQ ID NO: 122875 - DNA, 25 bp, Homo sapien
ttttctcaatctttaaatgagtctg

SEQ ID NO: 122876 - DNA, 25 bp, Homo sapien
ttttctcagaggttattaataccag

SEQ ID NO: 122877 - DNA, 25 bp, Homo sapien
ttttctcagaggttgttaataccag

SEQ ID NO: 122878 - DNA, 25 bp, Homo sapien
ttttctcagatacaggacatataaa

SEQ ID NO: 122879 - DNA, 25 bp, Homo sapien
ttttctcagatataggacatataaa

SEQ ID NO: 122880 - DNA, 25 bp, Homo sapien
ttttctcagctagatttcaactaga

SEQ ID NO: 122881 - DNA, 25 bp, Homo sapien
ttttctcagctaggtttcaactaga

SEQ ID NO: 122882 - DNA, 25 bp, Homo sapien
ttttctcagctcctctttgacagga

SEQ ID NO: 122883 - DNA, 25 bp, Homo sapien
ttttctcagctcgtctttgacagga

SEQ ID NO: 122884 - DNA, 25 bp, Homo sapien
ttttctcagtgtaaacatcaaagat

SEQ ID NO: 122885 - DNA, 25 bp, Homo sapien
ttttctcagtgtaaacgtcaaagat

SEQ ID NO: 122886 - DNA, 25 bp, Homo sapien
ttttctccagattttcaacctgtgc

SEQ ID NO: 122887 - DNA, 25 bp, Homo sapien
ttttctccagattttcgacctgtgc

SEQ ID NO: 122888 - DNA, 25 bp, Homo sapien
ttttctcccgtaatgcataatcagg

SEQ ID NO: 122889 - DNA, 25 bp, Homo sapien
ttttctcctctgtcctcacttggtc

SEQ ID NO: 122890 - DNA, 25 bp, Homo sapien
ttttctcctgaatgaaaccaccatg

SEQ ID NO: 122891 - DNA, 25 bp, Homo sapien
ttttctcctgagtgaaaccaccatg

SEQ ID NO: 122892 - DNA, 25 bp, Homo sapien
ttttctcctgtaatgcataatcagg

SEQ ID NO: 122893 - DNA, 25 bp, Homo sapien
ttttctcctgtgtcctcacttggtc

SEQ ID NO: 122894 - DNA, 25 bp, Homo sapien
ttttctctatcaccgtaggccctga

SEQ ID NO: 122895 - DNA, 25 bp, Homo sapien
ttttctctatcactgtaggccctga

SEQ ID NO: 122896 - DNA, 25 bp, Homo sapien
ttttctctgactcaattatgtggaa

SEQ ID NO: 122897 - DNA, 25 bp, Homo sapien
ttttctctgactcgattatgtggaa

SEQ ID NO: 122898 - DNA, 25 bp, Homo sapien
ttttctctgatagaatacatgttcc

SEQ ID NO: 122899 - DNA, 25 bp, Homo sapien
ttttctctgatagactacatgttcc

SEQ ID NO: 122900 - DNA, 25 bp, Homo sapien
ttttctgaacttctgaatgaaataa

SEQ ID NO: 122901 - DNA, 25 bp, Homo sapien
ttttctgaacttttgaatgaaataa

SEQ ID NO: 122902 - DNA, 25 bp, Homo sapien
ttttctgaaggactatgaagcttgg

SEQ ID NO: 122903 - DNA, 25 bp, Homo sapien
ttttctgaaggactgtgaagcttgg

SEQ ID NO: 122904 - DNA, 25 bp, Homo sapien
ttttctgaagttttccgtaatgtga

SEQ ID NO: 122905 - DNA, 25 bp, Homo sapien
ttttctgaagttttccttaatgtga

SEQ ID NO: 122906 - DNA, 25 bp, Homo sapien
ttttctgaatacgttcaatgcatgg

SEQ ID NO: 122907 - DNA, 25 bp, Homo sapien
ttttctgaatatgttcaatgcatgg

SEQ ID NO: 122908 - DNA, 25 bp, Homo sapien
ttttctgaatgataaaaaagtgaca

SEQ ID NO: 122909 - DNA, 25 bp, Homo sapien
ttttctgaatttatagtaacgactc

SEQ ID NO: 122910 - DNA, 25 bp, Homo sapien
ttttctgaatttttagtaacgactc

SEQ ID NO: 122911 - DNA, 25 bp, Homo sapien
ttttctgacttaatttttaataaca

SEQ ID NO: 122912 - DNA, 25 bp, Homo sapien
ttttctgagaattagatagaccacc

SEQ ID NO: 122913 - DNA, 25 bp, Homo sapien
ttttctgagaattatatagaccacc

SEQ ID NO: 122914 - DNA, 25 bp, Homo sapien
ttttctgattgataaaaaagtgaca

SEQ ID NO: 122915 - DNA, 25 bp, Homo sapien
ttttctgattgtgaattttgagacc

SEQ ID NO: 122916 - DNA, 25 bp, Homo sapien
ttttctgattgtgatttttgagacc

SEQ ID NO: 122917 - DNA, 25 bp, Homo sapien
ttttctgatttaatttttaataaca

SEQ ID NO: 122918 - DNA, 25 bp, Homo sapien
ttttctgcaataatgtaataatagt

SEQ ID NO: 122919 - DNA, 25 bp, Homo sapien
ttttctgcaatagtgtaataatagt

SEQ ID NO: 122920 - DNA, 25 bp, Homo sapien
ttttctgcagtgattcagcaattat

SEQ ID NO: 122921 - DNA, 25 bp, Homo sapien
ttttctgcatgacagatgaaaaatt

SEQ ID NO: 122922 - DNA, 25 bp, Homo sapien
ttttctgcattcctcaacataggag

SEQ ID NO: 122923 - DNA, 25 bp, Homo sapien
ttttctgcattgctcaacataggag

SEQ ID NO: 122924 - DNA, 25 bp, Homo sapien
ttttctgcgcagctcatcaatattg

SEQ ID NO: 122925 - DNA, 25 bp, Homo sapien
ttttctgcgcttagaatgctcctgc

SEQ ID NO: 122926 - DNA, 25 bp, Homo sapien
ttttctgcggtgattcagcaattat

SEQ ID NO: 122927 - DNA, 25 bp, Homo sapien
ttttctgcgtgacagatgaaaaatt

SEQ ID NO: 122928 - DNA, 25 bp, Homo sapien
ttttctgctaaaaggaaaggccact

SEQ ID NO: 122929 - DNA, 25 bp, Homo sapien
ttttctgctaacaggaaaggccact

SEQ ID NO: 122930 - DNA, 25 bp, Homo sapien
ttttctgctaggtagtaatttctag

SEQ ID NO: 122931 - DNA, 25 bp, Homo sapien
ttttctgctaggtggtaatttctag

SEQ ID NO: 122932 - DNA, 25 bp, Homo sapien
ttttctgctcagctcatcaatattg

SEQ ID NO: 122933 - DNA, 25 bp, Homo sapien
ttttctgctcttagaatgctcctgc

SEQ ID NO: 122934 - DNA, 25 bp, Homo sapien
ttttctggaggccttttctggaaac

SEQ ID NO: 122935 - DNA, 25 bp, Homo sapien
ttttctggaggtcttttctggaaac

SEQ ID NO: 122936 - DNA, 25 bp, Homo sapien
ttttctgggagactgttccctattg

SEQ ID NO: 122937 - DNA, 25 bp, Homo sapien
ttttctgggagagtgttccctattg

SEQ ID NO: 122938 - DNA, 25 bp, Homo sapien
ttttctgggcaacttttgtgtgcct

SEQ ID NO: 122939 - DNA, 25 bp, Homo sapien
ttttctgggcaatttttgtgtgcct

SEQ ID NO: 122940 - DNA, 25 bp, Homo sapien
ttttctgtaatgactttcagagtgc

SEQ ID NO: 122941 - DNA, 25 bp, Homo sapien
ttttctgtaatgattttcagagtgc

SEQ ID NO: 122942 - DNA, 25 bp, Homo sapien
ttttctgtacatcaggaagtataac

SEQ ID NO: 122943 - DNA, 25 bp, Homo sapien
ttttctgtacatcatgaagtataac

SEQ ID NO: 122944 - DNA, 25 bp, Homo sapien
ttttctgtagcacaatgcatcttca

SEQ ID NO: 122945 - DNA, 25 bp, Homo sapien
ttttctgtagcataatgcatcttca

SEQ ID NO: 122946 - DNA, 25 bp, Homo sapien
ttttctgtagcatgtatttacattg

SEQ ID NO: 122947 - DNA, 25 bp, Homo sapien
ttttctgtagcgtgtatttacattg

SEQ ID NO: 122948 - DNA, 25 bp, Homo sapien
ttttctgtcaagcagatggtgaggg

SEQ ID NO: 122949 - DNA, 25 bp, Homo sapien
ttttctgtcaagtagatggtgaggg

SEQ ID NO: 122950 - DNA, 25 bp, Homo sapien
ttttctgtctatcctgctaggcttt

SEQ ID NO: 122951 - DNA, 25 bp, Homo sapien
ttttctgtctgtacaacccttttga

SEQ ID NO: 122952 - DNA, 25 bp, Homo sapien
ttttctgtctgtataacccttttga

SEQ ID NO: 122953 - DNA, 25 bp, Homo sapien
ttttctgttacatctatctgtacct

SEQ ID NO: 122954 - DNA, 25 bp, Homo sapien
ttttctgttgcatctatctgtacct

SEQ ID NO: 122955 - DNA, 25 bp, Homo sapien
ttttctgtttatcctgctaggcttt

SEQ ID NO: 122956 - DNA, 25 bp, Homo sapien
ttttcttagctactaaaatctgttt

SEQ ID NO: 122957 - DNA, 25 bp, Homo sapien
ttttcttagctgctaaaatctgttt

SEQ ID NO: 122958 - DNA, 25 bp, Homo sapien
ttttcttattctctctaatcctgtt

SEQ ID NO: 122959 - DNA, 25 bp, Homo sapien
ttttcttattctgtctaatcctgtt

SEQ ID NO: 122960 - DNA, 25 bp, Homo sapien
ttttcttattgacgctcaaaaattc

SEQ ID NO: 122961 - DNA, 25 bp, Homo sapien
ttttcttattgaggctcaaaaattc

SEQ ID NO: 122962 - DNA, 25 bp, Homo sapien
ttttcttcaaaccaatatcacaaat

SEQ ID NO: 122963 - DNA, 25 bp, Homo sapien
ttttcttcaaaccagtatcacaaat

SEQ ID NO: 122964 - DNA, 25 bp, Homo sapien
ttttcttcaggacaagcaagacagc

SEQ ID NO: 122965 - DNA, 25 bp, Homo sapien
ttttcttcaggacgagcaagacagc

SEQ ID NO: 122966 - DNA, 25 bp, Homo sapien
ttttcttctcacatggaaggagact

SEQ ID NO: 122967 - DNA, 25 bp, Homo sapien
ttttcttctcacattgaaggagact

SEQ ID NO: 122968 - DNA, 25 bp, Homo sapien
ttttcttctcccgaatgcatttact

SEQ ID NO: 122969 - DNA, 25 bp, Homo sapien
ttttcttctcctgaatgcatttact

SEQ ID NO: 122970 - DNA, 25 bp, Homo sapien
ttttcttctctgtgattccaagtgt

SEQ ID NO: 122971 - DNA, 25 bp, Homo sapien
ttttcttctctgtggttccaagtgt

SEQ ID NO: 122972 - DNA, 25 bp, Homo sapien
ttttcttgcatacattctctctgta

SEQ ID NO: 122973 - DNA, 25 bp, Homo sapien
ttttcttgcatacgttctctctgta

SEQ ID NO: 122974 - DNA, 25 bp, Homo sapien
ttttcttgccttgagatatgaggct

SEQ ID NO: 122975 - DNA, 25 bp, Homo sapien
ttttcttgccttgatatatgaggct

SEQ ID NO: 122976 - DNA, 25 bp, Homo sapien
ttttcttggactctcaagtagtgta

SEQ ID NO: 122977 - DNA, 25 bp, Homo sapien
ttttcttggactgtcaagtagtgta

SEQ ID NO: 122978 - DNA, 25 bp, Homo sapien
ttttcttggtcagggttgttgtctt

SEQ ID NO: 122979 - DNA, 25 bp, Homo sapien
ttttcttggtccgggttgttgtctt

SEQ ID NO: 122980 - DNA, 25 bp, Homo sapien
ttttctttcacaggtatgaaggttg

SEQ ID NO: 122981 - DNA, 25 bp, Homo sapien
ttttctttcacgggtatgaaggttg

SEQ ID NO: 122982 - DNA, 25 bp, Homo sapien
ttttctttcagatatcagctcaaga

SEQ ID NO: 122983 - DNA, 25 bp, Homo sapien
ttttctttcgtgatacttatctcaa

SEQ ID NO: 122984 - DNA, 25 bp, Homo sapien
ttttctttctttgccttacattcct

SEQ ID NO: 122985 - DNA, 25 bp, Homo sapien
ttttctttctttggcttacattcct

SEQ ID NO: 122986 - DNA, 25 bp, Homo sapien
ttttctttgccaaataaggtaacaa

SEQ ID NO: 122987 - DNA, 25 bp, Homo sapien
ttttctttgccaagtaaggtaacaa

SEQ ID NO: 122988 - DNA, 25 bp, Homo sapien
ttttcttttagatatcagctcaaga

SEQ ID NO: 122989 - DNA, 25 bp, Homo sapien
ttttcttttagctcccacacgtgag

SEQ ID NO: 122990 - DNA, 25 bp, Homo sapien
ttttcttttagttcccacacgtgag

SEQ ID NO: 122991 - DNA, 25 bp, Homo sapien
ttttcttttccttgagtaatgaatg

SEQ ID NO: 122992 - DNA, 25 bp, Homo sapien
ttttcttttccttgggtaatgaatg

SEQ ID NO: 122993 - DNA, 25 bp, Homo sapien
ttttcttttgtatcagcttcctcca

SEQ ID NO: 122994 - DNA, 25 bp, Homo sapien
ttttcttttgtatcagtttcctcca

SEQ ID NO: 122995 - DNA, 25 bp, Homo sapien
ttttcttttgtgatacttatctcaa

SEQ ID NO: 122996 - DNA, 25 bp, Homo sapien
ttttgaaaaacgacacagcacagga

SEQ ID NO: 122997 - DNA, 25 bp, Homo sapien
ttttgaaaagcgacacagcacagga

SEQ ID NO: 122998 - DNA, 25 bp, Homo sapien
ttttgaaaatgacgtgctaagtctc

SEQ ID NO: 122999 - DNA, 25 bp, Homo sapien
ttttgaaaatgatgtgctaagtctc

SEQ ID NO: 123000 - DNA, 25 bp, Homo sapien
ttttgaaacgtaaacaaaagaggac

SEQ ID NO: 123001 - DNA, 25 bp, Homo sapien
ttttgaaagtgttcgtgttttttct

SEQ ID NO: 123002 - DNA, 25 bp, Homo sapien
ttttgaaagtgtttgtgttttttct

SEQ ID NO: 123003 - DNA, 25 bp, Homo sapien
ttttgaaatgtaaacaaaagaggac

SEQ ID NO: 123004 - DNA, 25 bp, Homo sapien
ttttgaacagcagctgtggaactca

SEQ ID NO: 123005 - DNA, 25 bp, Homo sapien
ttttgaacagcagttgtggaactca

SEQ ID NO: 123006 - DNA, 25 bp, Homo sapien
ttttgaacatacaattcggtgactt

SEQ ID NO: 123007 - DNA, 25 bp, Homo sapien
ttttgaacgtacaattcggtgactt

SEQ ID NO: 123008 - DNA, 25 bp, Homo sapien
ttttgaactggacaacgctaaagag

SEQ ID NO: 123009 - DNA, 25 bp, Homo sapien
ttttgaactggacatcgctaaagag

SEQ ID NO: 123010 - DNA, 25 bp, Homo sapien
ttttgaacttggagacttagattac

SEQ ID NO: 123011 - DNA, 25 bp, Homo sapien
ttttgaacttggggacttagattac

SEQ ID NO: 123012 - DNA, 25 bp, Homo sapien
ttttgaagacttctttttaatcctc

SEQ ID NO: 123013 - DNA, 25 bp, Homo sapien
ttttgaagacttgtttttaatcctc

SEQ ID NO: 123014 - DNA, 25 bp, Homo sapien
ttttgaagcttgtaacagaaatagg

SEQ ID NO: 123015 - DNA, 25 bp, Homo sapien
ttttgaagcttgtaccagaaatagg

SEQ ID NO: 123016 - DNA, 25 bp, Homo sapien
ttttgaataggctatcagttgccca

SEQ ID NO: 123017 - DNA, 25 bp, Homo sapien
ttttgaataggctatccgttgccca

SEQ ID NO: 123018 - DNA, 25 bp, Homo sapien
ttttgaatagtatcagacactttta

SEQ ID NO: 123019 - DNA, 25 bp, Homo sapien
ttttgaatagtattagacactttta

SEQ ID NO: 123020 - DNA, 25 bp, Homo sapien
ttttgaatgcatataaagcacttaa

SEQ ID NO: 123021 - DNA, 25 bp, Homo sapien
ttttgaatgcatgtaaagcacttaa

SEQ ID NO: 123022 - DNA, 25 bp, Homo sapien
ttttgaattaatacgaaagaggcaa

SEQ ID NO: 123023 - DNA, 25 bp, Homo sapien
ttttgaattaatatgaaagaggcaa

SEQ ID NO: 123024 - DNA, 25 bp, Homo sapien
ttttgaattcttccaatatgttaaa

SEQ ID NO: 123025 - DNA, 25 bp, Homo sapien
ttttgaattcttgcaatatgttaaa

SEQ ID NO: 123026 - DNA, 25 bp, Homo sapien
ttttgacacagagctacatacacag

SEQ ID NO: 123027 - DNA, 25 bp, Homo sapien
ttttgacacattacctacattactt

SEQ ID NO: 123028 - DNA, 25 bp, Homo sapien
ttttgacacattacttacattactt

SEQ ID NO: 123029 - DNA, 25 bp, Homo sapien
ttttgacaccaagaagtatgggaac

SEQ ID NO: 123030 - DNA, 25 bp, Homo sapien
ttttgacaccaggaagtatgggaac

SEQ ID NO: 123031 - DNA, 25 bp, Homo sapien
ttttgacacggagctacatacacag

SEQ ID NO: 123032 - DNA, 25 bp, Homo sapien
ttttgacagagctaatcacagggtg

SEQ ID NO: 123033 - DNA, 25 bp, Homo sapien
ttttgacagagttaatcacagggtg

SEQ ID NO: 123034 - DNA, 25 bp, Homo sapien
ttttgacagtttaacgtagccccag

SEQ ID NO: 123035 - DNA, 25 bp, Homo sapien
ttttgacagtttaatgtagccccag

SEQ ID NO: 123036 - DNA, 25 bp, Homo sapien
ttttgacccgtcactggttgaatcc

SEQ ID NO: 123037 - DNA, 25 bp, Homo sapien
ttttgacccgtcattggttgaatcc

SEQ ID NO: 123038 - DNA, 25 bp, Homo sapien
ttttgaccgccttggcttgtagatg

SEQ ID NO: 123039 - DNA, 25 bp, Homo sapien
ttttgaccgcctttgcttgtagatg

SEQ ID NO: 123040 - DNA, 25 bp, Homo sapien
ttttgactagccatgactgacttat

SEQ ID NO: 123041 - DNA, 25 bp, Homo sapien
ttttgactgcttgcttcaactatta

SEQ ID NO: 123042 - DNA, 25 bp, Homo sapien
ttttgactgcttgctttaactatta

SEQ ID NO: 123043 - DNA, 25 bp, Homo sapien
ttttgactggccatgactgacttat

SEQ ID NO: 123044 - DNA, 25 bp, Homo sapien
ttttgactttcccattgcagtggct

SEQ ID NO: 123045 - DNA, 25 bp, Homo sapien
ttttgactttcccgttgcagtggct

SEQ ID NO: 123046 - DNA, 25 bp, Homo sapien
ttttgagatgaaatggttccaccta

SEQ ID NO: 123047 - DNA, 25 bp, Homo sapien
ttttgagatgaagtggttccaccta

SEQ ID NO: 123048 - DNA, 25 bp, Homo sapien
ttttgagattaccgtgcaatcagtt

SEQ ID NO: 123049 - DNA, 25 bp, Homo sapien
ttttgagattactgtgcaatcagtt

SEQ ID NO: 123050 - DNA, 25 bp, Homo sapien
ttttgagcacgtcattactttctgg

SEQ ID NO: 123051 - DNA, 25 bp, Homo sapien
ttttgagcatcaaggaatacatttt

SEQ ID NO: 123052 - DNA, 25 bp, Homo sapien
ttttgagcatcagggaatacatttt

SEQ ID NO: 123053 - DNA, 25 bp, Homo sapien
ttttgagcatgtcattactttctgg

SEQ ID NO: 123054 - DNA, 25 bp, Homo sapien
ttttgagctagtttttatatcctct

SEQ ID NO: 123055 - DNA, 25 bp, Homo sapien
ttttgagcttgtttttatatcctct

SEQ ID NO: 123056 - DNA, 25 bp, Homo sapien
ttttgaggatggctgttatccttct

SEQ ID NO: 123057 - DNA, 25 bp, Homo sapien
ttttgaggatgggtgttatccttct

SEQ ID NO: 123058 - DNA, 25 bp, Homo sapien
ttttgagtaagagatttttctggat

SEQ ID NO: 123059 - DNA, 25 bp, Homo sapien
ttttgagtaagggatttttctggat

SEQ ID NO: 123060 - DNA, 25 bp, Homo sapien
ttttgagtcaaaaagtaacttcggt

SEQ ID NO: 123061 - DNA, 25 bp, Homo sapien
ttttgagtgaaaaagtaacttcggt

SEQ ID NO: 123062 - DNA, 25 bp, Homo sapien
ttttgagtgactttcgttttcttct

SEQ ID NO: 123063 - DNA, 25 bp, Homo sapien
ttttgagtgacttttgttttcttct

SEQ ID NO: 123064 - DNA, 25 bp, Homo sapien
ttttgagttaggcgagaacagtggt

SEQ ID NO: 123065 - DNA, 25 bp, Homo sapien
ttttgagttaggtgagaacagtggt

SEQ ID NO: 123066 - DNA, 25 bp, Homo sapien
ttttgatacagattacaattactat

SEQ ID NO: 123067 - DNA, 25 bp, Homo sapien
ttttgatacagtttgttagaacctg

SEQ ID NO: 123068 - DNA, 25 bp, Homo sapien
ttttgatagagattacaattactat

SEQ ID NO: 123069 - DNA, 25 bp, Homo sapien
ttttgatatagtttgttagaacctg

SEQ ID NO: 123070 - DNA, 25 bp, Homo sapien
ttttgatatctatcaatggagaagg

SEQ ID NO: 123071 - DNA, 25 bp, Homo sapien
ttttgatatctctcaatggagaagg

SEQ ID NO: 123072 - DNA, 25 bp, Homo sapien
ttttgatgcatttgggtaagtaaat

SEQ ID NO: 123073 - DNA, 25 bp, Homo sapien
ttttgatgcgtttgggtaagtaaat

SEQ ID NO: 123074 - DNA, 25 bp, Homo sapien
ttttgatgggacatggctgcctaga

SEQ ID NO: 123075 - DNA, 25 bp, Homo sapien
ttttgatgggacttggctgcctaga

SEQ ID NO: 123076 - DNA, 25 bp, Homo sapien
ttttgattattcattaacttcatct

SEQ ID NO: 123077 - DNA, 25 bp, Homo sapien
ttttgattattcattagcttcatct

SEQ ID NO: 123078 - DNA, 25 bp, Homo sapien
ttttgattttttgtaagactcatct

SEQ ID NO: 123079 - DNA, 25 bp, Homo sapien
ttttgattttttgtgagactcatct

SEQ ID NO: 123080 - DNA, 25 bp, Homo sapien
ttttgcaaagtacccaattcactac

SEQ ID NO: 123081 - DNA, 25 bp, Homo sapien
ttttgcaaagtacccagttcactac

SEQ ID NO: 123082 - DNA, 25 bp, Homo sapien
ttttgcaatcatctggaatatccac

SEQ ID NO: 123083 - DNA, 25 bp, Homo sapien
ttttgcaattagccgaacacgtagc

SEQ ID NO: 123084 - DNA, 25 bp, Homo sapien
ttttgcaattagctgaacacgtagc

SEQ ID NO: 123085 - DNA, 25 bp, Homo sapien
ttttgcaattatctggaatatccac

SEQ ID NO: 123086 - DNA, 25 bp, Homo sapien
ttttgcaattctttactctaatcca

SEQ ID NO: 123087 - DNA, 25 bp, Homo sapien
ttttgcaattctttgctctaatcca

SEQ ID NO: 123088 - DNA, 25 bp, Homo sapien
ttttgcaccaatgagggacacgagg

SEQ ID NO: 123089 - DNA, 25 bp, Homo sapien
ttttgcacgaatgagggacacgagg

SEQ ID NO: 123090 - DNA, 25 bp, Homo sapien
ttttgcactcggaccgcttcacagg

SEQ ID NO: 123091 - DNA, 25 bp, Homo sapien
ttttgcactcggactgcttcacagg

SEQ ID NO: 123092 - DNA, 25 bp, Homo sapien
ttttgcagactctaaagaggccacc

SEQ ID NO: 123093 - DNA, 25 bp, Homo sapien
ttttgcagactctgaagaggccacc

SEQ ID NO: 123094 - DNA, 25 bp, Homo sapien
ttttgcagctatgattatggatatt

SEQ ID NO: 123095 - DNA, 25 bp, Homo sapien
ttttgcagctatgattgtggatatt

SEQ ID NO: 123096 - DNA, 25 bp, Homo sapien
ttttgcaggcatactggaggaaacc

SEQ ID NO: 123097 - DNA, 25 bp, Homo sapien
ttttgcaggccttaagtatggcaga

SEQ ID NO: 123098 - DNA, 25 bp, Homo sapien
ttttgcaggccttgagtatggcaga

SEQ ID NO: 123099 - DNA, 25 bp, Homo sapien
ttttgcagtcatactggaggaaacc

SEQ ID NO: 123100 - DNA, 25 bp, Homo sapien
ttttgcataccaattacaactctgc

SEQ ID NO: 123101 - DNA, 25 bp, Homo sapien
ttttgcataccgattacaactctgc

SEQ ID NO: 123102 - DNA, 25 bp, Homo sapien
ttttgcatcatttcctttgtattat

SEQ ID NO: 123103 - DNA, 25 bp, Homo sapien
ttttgcatcatttcttttgtattat

SEQ ID NO: 123104 - DNA, 25 bp, Homo sapien
ttttgccaattctcaagtatttcaa

SEQ ID NO: 123105 - DNA, 25 bp, Homo sapien
ttttgccaattctcaattatttcaa

SEQ ID NO: 123106 - DNA, 25 bp, Homo sapien
ttttgccaggaactgaatgcccata

SEQ ID NO: 123107 - DNA, 25 bp, Homo sapien
ttttgccaggaattgaatgcccata

SEQ ID NO: 123108 - DNA, 25 bp, Homo sapien
ttttgccatccactctattttcctc

SEQ ID NO: 123109 - DNA, 25 bp, Homo sapien
ttttgccattcactctattttcctc

SEQ ID NO: 123110 - DNA, 25 bp, Homo sapien
ttttgcccaccttaatgataaaatg

SEQ ID NO: 123111 - DNA, 25 bp, Homo sapien
ttttgccccccttaatgataaaatg

SEQ ID NO: 123112 - DNA, 25 bp, Homo sapien
ttttgcctatcacgaggccctggta

SEQ ID NO: 123113 - DNA, 25 bp, Homo sapien
ttttgcctatcatgaggccctggta

SEQ ID NO: 123114 - DNA, 25 bp, Homo sapien
ttttgcctctaaggacaccaggctc

SEQ ID NO: 123115 - DNA, 25 bp, Homo sapien
ttttgcctctaaggacgccaggctc

SEQ ID NO: 123116 - DNA, 25 bp, Homo sapien
ttttgcctctgaggacatatgccaa

SEQ ID NO: 123117 - DNA, 25 bp, Homo sapien
ttttgcctctgaggacctatgccaa

SEQ ID NO: 123118 - DNA, 25 bp, Homo sapien
ttttgcctctgccgtctcttgctgt

SEQ ID NO: 123119 - DNA, 25 bp, Homo sapien
ttttgcctctgctgtctcttgctgt

SEQ ID NO: 123120 - DNA, 25 bp, Homo sapien
ttttgcctgggaaaaagtcttggaa

SEQ ID NO: 123121 - DNA, 25 bp, Homo sapien
ttttgcctgggaagaagtcttggaa

SEQ ID NO: 123122 - DNA, 25 bp, Homo sapien
ttttgccttcattattcagtggttt

SEQ ID NO: 123123 - DNA, 25 bp, Homo sapien
ttttgccttcattcttcagtggttt

SEQ ID NO: 123124 - DNA, 25 bp, Homo sapien
ttttgctagagaatgaaatcaaagc

SEQ ID NO: 123125 - DNA, 25 bp, Homo sapien
ttttgctatagaatgaaatcaaagc

SEQ ID NO: 123126 - DNA, 25 bp, Homo sapien
ttttgctatccactgaattgttacc

SEQ ID NO: 123127 - DNA, 25 bp, Homo sapien
ttttgctatccattgaattgttacc

SEQ ID NO: 123128 - DNA, 25 bp, Homo sapien
ttttgctatgccattgtattcactt

SEQ ID NO: 123129 - DNA, 25 bp, Homo sapien
ttttgctatgctattgtattcactt

SEQ ID NO: 123130 - DNA, 25 bp, Homo sapien
ttttgctattacggtaatgctagct

SEQ ID NO: 123131 - DNA, 25 bp, Homo sapien
ttttgctattagggtaatgctagct

SEQ ID NO: 123132 - DNA, 25 bp, Homo sapien
ttttgctcaatgtagtcactttgtc

SEQ ID NO: 123133 - DNA, 25 bp, Homo sapien
ttttgctcagtgtagtcactttgtc

SEQ ID NO: 123134 - DNA, 25 bp, Homo sapien
ttttgctctatagccccgacagctg

SEQ ID NO: 123135 - DNA, 25 bp, Homo sapien
ttttgctctatatccccgacagctg

SEQ ID NO: 123136 - DNA, 25 bp, Homo sapien
ttttgctctctggtccatgatattg

SEQ ID NO: 123137 - DNA, 25 bp, Homo sapien
ttttgctctctggtccctgatattg

SEQ ID NO: 123138 - DNA, 25 bp, Homo sapien
ttttgctgaaaacgtgaacttgtta

SEQ ID NO: 123139 - DNA, 25 bp, Homo sapien
ttttgctgaaaatgtgaacttgtta

SEQ ID NO: 123140 - DNA, 25 bp, Homo sapien
ttttgctgaaggaatttttattaca

SEQ ID NO: 123141 - DNA, 25 bp, Homo sapien
ttttgctgacataaaagctgcaggt

SEQ ID NO: 123142 - DNA, 25 bp, Homo sapien
ttttgctgacataagagctgcaggt

SEQ ID NO: 123143 - DNA, 25 bp, Homo sapien
ttttgctggaggaatttttattaca

SEQ ID NO: 123144 - DNA, 25 bp, Homo sapien
ttttgctggatatgaaattttgggt

SEQ ID NO: 123145 - DNA, 25 bp, Homo sapien
ttttgctggatatggaattttgggt

SEQ ID NO: 123146 - DNA, 25 bp, Homo sapien
ttttgctgtttgatttatatgaaag

SEQ ID NO: 123147 - DNA, 25 bp, Homo sapien
ttttgctgtttgttttatatgaaag

SEQ ID NO: 123148 - DNA, 25 bp, Homo sapien
ttttgcttaatcaattctgctttta

SEQ ID NO: 123149 - DNA, 25 bp, Homo sapien
ttttgcttaatcagttctgctttta

SEQ ID NO: 123150 - DNA, 25 bp, Homo sapien
ttttgcttcagttttgtgttagttt

SEQ ID NO: 123151 - DNA, 25 bp, Homo sapien
ttttgcttcgggcaatatcctaaga

SEQ ID NO: 123152 - DNA, 25 bp, Homo sapien
ttttgcttgagttttgtgttagttt

SEQ ID NO: 123153 - DNA, 25 bp, Homo sapien
ttttgctttgcatgctgtgtacgct

SEQ ID NO: 123154 - DNA, 25 bp, Homo sapien
ttttgctttgcatgttgtgtacgct

SEQ ID NO: 123155 - DNA, 25 bp, Homo sapien
ttttgctttgggcaatatcctaaga

SEQ ID NO: 123156 - DNA, 25 bp, Homo sapien
ttttggaacacaaacccattcatct

SEQ ID NO: 123157 - DNA, 25 bp, Homo sapien
ttttggaatacaaacccattcatct

SEQ ID NO: 123158 - DNA, 25 bp, Homo sapien
ttttggacagggtcgtgtgatggtt

SEQ ID NO: 123159 - DNA, 25 bp, Homo sapien
ttttggacagggttgtgtgatggtt

SEQ ID NO: 123160 - DNA, 25 bp, Homo sapien
ttttggaccatcaatgctttcctaa

SEQ ID NO: 123161 - DNA, 25 bp, Homo sapien
ttttggaccatcagtgctttcctaa

SEQ ID NO: 123162 - DNA, 25 bp, Homo sapien
ttttggactttatacaggaaataat

SEQ ID NO: 123163 - DNA, 25 bp, Homo sapien
ttttggactttatagaggaaataat

SEQ ID NO: 123164 - DNA, 25 bp, Homo sapien
ttttggagacttagccataaattat

SEQ ID NO: 123165 - DNA, 25 bp, Homo sapien
ttttggagacttagccgtaaattat

SEQ ID NO: 123166 - DNA, 25 bp, Homo sapien
ttttggatgcgaatggaatgggcag

SEQ ID NO: 123167 - DNA, 25 bp, Homo sapien
ttttggatgtgaatggaatgggcag

SEQ ID NO: 123168 - DNA, 25 bp, Homo sapien
ttttggattgtatcttagacattgt

SEQ ID NO: 123169 - DNA, 25 bp, Homo sapien
ttttggattgtatgttagacattgt

SEQ ID NO: 123170 - DNA, 25 bp, Homo sapien
ttttggcaaagcacctatttgaatc

SEQ ID NO: 123171 - DNA, 25 bp, Homo sapien
ttttggcaaagcacctgtttgaatc

SEQ ID NO: 123172 - DNA, 25 bp, Homo sapien
ttttggcagttaccctttgtcaagt

SEQ ID NO: 123173 - DNA, 25 bp, Homo sapien
ttttggcagttactctttgtcaagt

SEQ ID NO: 123174 - DNA, 25 bp, Homo sapien
ttttggccattacgttattgtccag

SEQ ID NO: 123175 - DNA, 25 bp, Homo sapien
ttttggccattatggtattgtccag

SEQ ID NO: 123176 - DNA, 25 bp, Homo sapien
ttttggccattatgttattgtccag

SEQ ID NO: 123177 - DNA, 25 bp, Homo sapien
ttttggcctgaaacatcgttcatgg

SEQ ID NO: 123178 - DNA, 25 bp, Homo sapien
ttttggcctgaaacatggttcatgg

SEQ ID NO: 123179 - DNA, 25 bp, Homo sapien
ttttggccttgatatttttctgtct

SEQ ID NO: 123180 - DNA, 25 bp, Homo sapien
ttttggccttgctatttttctgtct

SEQ ID NO: 123181 - DNA, 25 bp, Homo sapien
ttttggctcatgcttctacaaactg

SEQ ID NO: 123182 - DNA, 25 bp, Homo sapien
ttttggctctgttctcaacttcttc

SEQ ID NO: 123183 - DNA, 25 bp, Homo sapien
ttttggctgtgttctcaacttcttc

SEQ ID NO: 123184 - DNA, 25 bp, Homo sapien
ttttggcttatgcttctacaaactg

SEQ ID NO: 123185 - DNA, 25 bp, Homo sapien
ttttgggagacctaacaggttttga

SEQ ID NO: 123186 - DNA, 25 bp, Homo sapien
ttttgggagacctgacaggttttga

SEQ ID NO: 123187 - DNA, 25 bp, Homo sapien
ttttgggaggtaatgcaagaaaaca

SEQ ID NO: 123188 - DNA, 25 bp, Homo sapien
ttttgggaggtagtgcaagaaaaca

SEQ ID NO: 123189 - DNA, 25 bp, Homo sapien
ttttgggcacaaataccacatatta

SEQ ID NO: 123190 - DNA, 25 bp, Homo sapien
ttttgggcacaaatcccacatatta

SEQ ID NO: 123191 - DNA, 25 bp, Homo sapien
ttttggggaaattagtttgattttc

SEQ ID NO: 123192 - DNA, 25 bp, Homo sapien
ttttggggaaattattttgattttc

SEQ ID NO: 123193 - DNA, 25 bp, Homo sapien
ttttgggtcatggtgttttagtctt

SEQ ID NO: 123194 - DNA, 25 bp, Homo sapien
ttttgggtcatggttttttagtctt

SEQ ID NO: 123195 - DNA, 25 bp, Homo sapien
ttttggtacatatttaacagaggag

SEQ ID NO: 123196 - DNA, 25 bp, Homo sapien
ttttggtacatatttagcagaggag

SEQ ID NO: 123197 - DNA, 25 bp, Homo sapien
ttttggtagacaaatgcagtatgtg

SEQ ID NO: 123198 - DNA, 25 bp, Homo sapien
ttttggtagacatatgcagtatgtg

SEQ ID NO: 123199 - DNA, 25 bp, Homo sapien
ttttggtatacacactaaagaaatt

SEQ ID NO: 123200 - DNA, 25 bp, Homo sapien
ttttggtattcacactaaagaaatt

SEQ ID NO: 123201 - DNA, 25 bp, Homo sapien
ttttggtgctccactctagtatatg

SEQ ID NO: 123202 - DNA, 25 bp, Homo sapien
ttttggtgctccgctctagtatatg

SEQ ID NO: 123203 - DNA, 25 bp, Homo sapien
ttttggttatgtcacagccagtggg

SEQ ID NO: 123204 - DNA, 25 bp, Homo sapien
ttttggttatgtcatagccagtggg

SEQ ID NO: 123205 - DNA, 25 bp, Homo sapien
ttttggttctaagccaacctatgac

SEQ ID NO: 123206 - DNA, 25 bp, Homo sapien
ttttggttctaggccaacctatgac

SEQ ID NO: 123207 - DNA, 25 bp, Homo sapien
ttttggttctctatgtctgcactgc

SEQ ID NO: 123208 - DNA, 25 bp, Homo sapien
ttttggttctctgtgtctgcactgc

SEQ ID NO: 123209 - DNA, 25 bp, Homo sapien
ttttgtaatgcatgacccaaagtgt

SEQ ID NO: 123210 - DNA, 25 bp, Homo sapien
ttttgtaatgcatgtcccaaagtgt

SEQ ID NO: 123211 - DNA, 25 bp, Homo sapien
ttttgtaattttcattgctctcctt

SEQ ID NO: 123212 - DNA, 25 bp, Homo sapien
ttttgtaattttcgttgctctcctt

SEQ ID NO: 123213 - DNA, 25 bp, Homo sapien
ttttgtacctttcaatttcaacaaa

SEQ ID NO: 123214 - DNA, 25 bp, Homo sapien
ttttgtacctttcattttcaacaaa

SEQ ID NO: 123215 - DNA, 25 bp, Homo sapien
ttttgtactctactggctgttctgc

SEQ ID NO: 123216 - DNA, 25 bp, Homo sapien
ttttgtactctattggctgttctgc

SEQ ID NO: 123217 - DNA, 25 bp, Homo sapien
ttttgtagacatgattaagagcatc

SEQ ID NO: 123218 - DNA, 25 bp, Homo sapien
ttttgtagacatggttaagagcatc

SEQ ID NO: 123219 - DNA, 25 bp, Homo sapien
ttttgtagagacaaggtcttcctat

SEQ ID NO: 123220 - DNA, 25 bp, Homo sapien
ttttgtagagacgaggtcttcctat

SEQ ID NO: 123221 - DNA, 25 bp, Homo sapien
ttttgtagcataactagaagtcagg

SEQ ID NO: 123222 - DNA, 25 bp, Homo sapien
ttttgtagcgcaaatcagtagttgg

SEQ ID NO: 123223 - DNA, 25 bp, Homo sapien
ttttgtagcgtaactagaagtcagg

SEQ ID NO: 123224 - DNA, 25 bp, Homo sapien
ttttgtaggtcaagtttggaccggg

SEQ ID NO: 123225 - DNA, 25 bp, Homo sapien
ttttgtaggtcgagtttggaccggg

SEQ ID NO: 123226 - DNA, 25 bp, Homo sapien
ttttgtagtgcaaatcagtagttgg

SEQ ID NO: 123227 - DNA, 25 bp, Homo sapien
ttttgtatacctatgcctatcatat

SEQ ID NO: 123228 - DNA, 25 bp, Homo sapien
ttttgtatacctatgcttatcatat

SEQ ID NO: 123229 - DNA, 25 bp, Homo sapien
ttttgtatatggtaaaccttttgct

SEQ ID NO: 123230 - DNA, 25 bp, Homo sapien
ttttgtatgtggtaaaccttttgct

SEQ ID NO: 123231 - DNA, 25 bp, Homo sapien
ttttgtatttggatgtctggatctc

SEQ ID NO: 123232 - DNA, 25 bp, Homo sapien
ttttgtatttggatttctggatctc

SEQ ID NO: 123233 - DNA, 25 bp, Homo sapien
ttttgtatttttcactttagattca

SEQ ID NO: 123234 - DNA, 25 bp, Homo sapien
ttttgtatttttcattttagattca

SEQ ID NO: 123235 - DNA, 25 bp, Homo sapien
ttttgtcaatccataatctgatagg

SEQ ID NO: 123236 - DNA, 25 bp, Homo sapien
ttttgtcaatccgtaatctgatagg

SEQ ID NO: 123237 - DNA, 25 bp, Homo sapien
ttttgtcactgtagaactctaacat

SEQ ID NO: 123238 - DNA, 25 bp, Homo sapien
ttttgtcactgtagaagtctaacat

SEQ ID NO: 123239 - DNA, 25 bp, Homo sapien
ttttgtcagaaaacgaagtcattac

SEQ ID NO: 123240 - DNA, 25 bp, Homo sapien
ttttgtcagaaaatgaagtcattac

SEQ ID NO: 123241 - DNA, 25 bp, Homo sapien
ttttgtcagacagcatgttcttatt

SEQ ID NO: 123242 - DNA, 25 bp, Homo sapien
ttttgtcaggcagcatgttcttatt

SEQ ID NO: 123243 - DNA, 25 bp, Homo sapien
ttttgtcagtcttacgatttctatt

SEQ ID NO: 123244 - DNA, 25 bp, Homo sapien
ttttgtcagtcttatgatttctatt

SEQ ID NO: 123245 - DNA, 25 bp, Homo sapien
ttttgtcatttcgggatgagaagtt

SEQ ID NO: 123246 - DNA, 25 bp, Homo sapien
ttttgtcattttgggatgagaagtt

SEQ ID NO: 123247 - DNA, 25 bp, Homo sapien
ttttgtccttgaagacctcctggaa

SEQ ID NO: 123248 - DNA, 25 bp, Homo sapien
ttttgtccttgcagacctcctggaa

SEQ ID NO: 123249 - DNA, 25 bp, Homo sapien
ttttgtctacactgacaatctgttg

SEQ ID NO: 123250 - DNA, 25 bp, Homo sapien
ttttgtctacatcaacaatcatttg

SEQ ID NO: 123251 - DNA, 25 bp, Homo sapien
ttttgtctacattaacaatcatttg

SEQ ID NO: 123252 - DNA, 25 bp, Homo sapien
ttttgtctacattgacaatctgttg

SEQ ID NO: 123253 - DNA, 25 bp, Homo sapien
ttttgtctcatggttacattatggc

SEQ ID NO: 123254 - DNA, 25 bp, Homo sapien
ttttgtctcgtggttacattatggc

SEQ ID NO: 123255 - DNA, 25 bp, Homo sapien
ttttgtctgcgaaaatctataactc

SEQ ID NO: 123256 - DNA, 25 bp, Homo sapien
ttttgtctgtgaaaatctataactc

SEQ ID NO: 123257 - DNA, 25 bp, Homo sapien
ttttgtctttatcgtttgttagagt

SEQ ID NO: 123258 - DNA, 25 bp, Homo sapien
ttttgtctttatcttttgttagagt

SEQ ID NO: 123259 - DNA, 25 bp, Homo sapien
ttttgtctttcacaattgcctagaa

SEQ ID NO: 123260 - DNA, 25 bp, Homo sapien
ttttgtctttcataattgcctagaa

SEQ ID NO: 123261 - DNA, 25 bp, Homo sapien
ttttgtcttttacatttttcactta

SEQ ID NO: 123262 - DNA, 25 bp, Homo sapien
ttttgtcttttacgtttttcactta

SEQ ID NO: 123263 - DNA, 25 bp, Homo sapien
ttttgtgacatgtaataaatgttca

SEQ ID NO: 123264 - DNA, 25 bp, Homo sapien
ttttgtgacgtgtaataaatgttca

SEQ ID NO: 123265 - DNA, 25 bp, Homo sapien
ttttgtgactgagtctcgctccaag

SEQ ID NO: 123266 - DNA, 25 bp, Homo sapien
ttttgtgactgagtcttgctccaag

SEQ ID NO: 123267 - DNA, 25 bp, Homo sapien
ttttgtgagctacgactctggaaaa

SEQ ID NO: 123268 - DNA, 25 bp, Homo sapien
ttttgtgagctatgactctggaaaa

SEQ ID NO: 123269 - DNA, 25 bp, Homo sapien
ttttgtgcaactcagtactttaaca

SEQ ID NO: 123270 - DNA, 25 bp, Homo sapien
ttttgtgcaactcagtgctttaaca

SEQ ID NO: 123271 - DNA, 25 bp, Homo sapien
ttttgtgcacgaggcattttaaact

SEQ ID NO: 123272 - DNA, 25 bp, Homo sapien
ttttgtgcatgaggcattttaaact

SEQ ID NO: 123273 - DNA, 25 bp, Homo sapien
ttttgtggaaggaaggactattcaa

SEQ ID NO: 123274 - DNA, 25 bp, Homo sapien
ttttgtggatcataggcccccagca

SEQ ID NO: 123275 - DNA, 25 bp, Homo sapien
ttttgtggatcatgggcccccagca

SEQ ID NO: 123276 - DNA, 25 bp, Homo sapien
ttttgtggcaggaaggactattcaa

SEQ ID NO: 123277 - DNA, 25 bp, Homo sapien
ttttgtggccatgtttccgtgtcag

SEQ ID NO: 123278 - DNA, 25 bp, Homo sapien
ttttgtggctatgtttccgtgtcag

SEQ ID NO: 123279 - DNA, 25 bp, Homo sapien
ttttgtgggtaacagtacctgctat

SEQ ID NO: 123280 - DNA, 25 bp, Homo sapien
ttttgtgggtaatagtacctgctat

SEQ ID NO: 123281 - DNA, 25 bp, Homo sapien
ttttgtggtcattctcctcactcga

SEQ ID NO: 123282 - DNA, 25 bp, Homo sapien
ttttgtggtcattttcctcactcga

SEQ ID NO: 123283 - DNA, 25 bp, Homo sapien
ttttgtggtcttcagtaagttgtat

SEQ ID NO: 123284 - DNA, 25 bp, Homo sapien
ttttgtggtctttagtaagttgtat

SEQ ID NO: 123285 - DNA, 25 bp, Homo sapien
ttttgtggtgcatagggcgattgcc

SEQ ID NO: 123286 - DNA, 25 bp, Homo sapien
ttttgtggtgcgtagggcgattgcc

SEQ ID NO: 123287 - DNA, 25 bp, Homo sapien
ttttgtgttgaatgtgttcaagaaa

SEQ ID NO: 123288 - DNA, 25 bp, Homo sapien
ttttgtgttgagtgtgttcaagaaa

SEQ ID NO: 123289 - DNA, 25 bp, Homo sapien
ttttgttacagcagtgccccacttc

SEQ ID NO: 123290 - DNA, 25 bp, Homo sapien
ttttgttactacattgagatacacc

SEQ ID NO: 123291 - DNA, 25 bp, Homo sapien
ttttgttactacattgcgatacacc

SEQ ID NO: 123292 - DNA, 25 bp, Homo sapien
ttttgttagagcagtgccccacttc

SEQ ID NO: 123293 - DNA, 25 bp, Homo sapien
ttttgttatttcgctgagaatgata

SEQ ID NO: 123294 - DNA, 25 bp, Homo sapien
ttttgttattttgctgagaatgata

SEQ ID NO: 123295 - DNA, 25 bp, Homo sapien
ttttgttcagacttgccttcccagg

SEQ ID NO: 123296 - DNA, 25 bp, Homo sapien
ttttgttcagatttgccttcccagg

SEQ ID NO: 123297 - DNA, 25 bp, Homo sapien
ttttgttcagtgttttatccccaga

SEQ ID NO: 123298 - DNA, 25 bp, Homo sapien
ttttgttcagtgttttgtccccaga

SEQ ID NO: 123299 - DNA, 25 bp, Homo sapien
ttttgttctgaggatagtggccttt

SEQ ID NO: 123300 - DNA, 25 bp, Homo sapien
ttttgttctgagggtagtggccttt

SEQ ID NO: 123301 - DNA, 25 bp, Homo sapien
ttttgttgatgctaagcttgcatgt

SEQ ID NO: 123302 - DNA, 25 bp, Homo sapien
ttttgttgatgctatgcttgcatgt

SEQ ID NO: 123303 - DNA, 25 bp, Homo sapien
ttttgttgtcatagaggcaaatgag

SEQ ID NO: 123304 - DNA, 25 bp, Homo sapien
ttttgttgtcatagagtcaaatgag

SEQ ID NO: 123305 - DNA, 25 bp, Homo sapien
ttttgttgtcctccgattttatcat

SEQ ID NO: 123306 - DNA, 25 bp, Homo sapien
ttttgttgtcctctgattttatcat

SEQ ID NO: 123307 - DNA, 25 bp, Homo sapien
ttttgtttagtaatgatgccttgca

SEQ ID NO: 123308 - DNA, 25 bp, Homo sapien
ttttgtttagtattgatgccttgca

SEQ ID NO: 123309 - DNA, 25 bp, Homo sapien
ttttgtttccctggttttctactat

SEQ ID NO: 123310 - DNA, 25 bp, Homo sapien
ttttgtttccctgtttttctactat

SEQ ID NO: 123311 - DNA, 25 bp, Homo sapien
ttttgttttcttaacatttgtgtat

SEQ ID NO: 123312 - DNA, 25 bp, Homo sapien
ttttgttttcttaatatttgtgtat

SEQ ID NO: 123313 - DNA, 25 bp, Homo sapien
ttttgtttttatagaggcggagttt

SEQ ID NO: 123314 - DNA, 25 bp, Homo sapien
ttttgtttttattgaggcggagttt

SEQ ID NO: 123315 - DNA, 25 bp, Homo sapien
ttttgttttttcatgactgcgtact

SEQ ID NO: 123316 - DNA, 25 bp, Homo sapien
ttttgtttttttatgactgcgtact

SEQ ID NO: 123317 - DNA, 25 bp, Homo sapien
tttttaaaaaatcaagcagaaatgc

SEQ ID NO: 123318 - DNA, 25 bp, Homo sapien
tttttaaaatatcaagcagaaatgc

SEQ ID NO: 123319 - DNA, 25 bp, Homo sapien
tttttaaaattgctcatgctggctt

SEQ ID NO: 123320 - DNA, 25 bp, Homo sapien
tttttaaaatttctcatgctggctt

SEQ ID NO: 123321 - DNA, 25 bp, Homo sapien
tttttaaacacggcacttttggcca

SEQ ID NO: 123322 - DNA, 25 bp, Homo sapien
tttttaaacacggcgcttttggcca

SEQ ID NO: 123323 - DNA, 25 bp, Homo sapien
tttttaaactcaagacttcctcata

SEQ ID NO: 123324 - DNA, 25 bp, Homo sapien
tttttaaactcaagtcttcctcata

SEQ ID NO: 123325 - DNA, 25 bp, Homo sapien
tttttaacacttaataagcagcaag

SEQ ID NO: 123326 - DNA, 25 bp, Homo sapien
tttttaacatttaataagcagcaag

SEQ ID NO: 123327 - DNA, 25 bp, Homo sapien
tttttaagatccagattttttcttt

SEQ ID NO: 123328 - DNA, 25 bp, Homo sapien
tttttaagatccatattttttcttt

SEQ ID NO: 123329 - DNA, 25 bp, Homo sapien
tttttaatattttttccaattattg

SEQ ID NO: 123330 - DNA, 25 bp, Homo sapien
tttttaatctgtgaacgtgtaagtc

SEQ ID NO: 123331 - DNA, 25 bp, Homo sapien
tttttaatgttcgagtgtttctgct

SEQ ID NO: 123332 - DNA, 25 bp, Homo sapien
tttttaatgtttgagtgtttctgct

SEQ ID NO: 123333 - DNA, 25 bp, Homo sapien
tttttaatgttttttccaattattg

SEQ ID NO: 123334 - DNA, 25 bp, Homo sapien
tttttaatttgtgaacgtgtaagtc

SEQ ID NO: 123335 - DNA, 25 bp, Homo sapien
tttttacaaagaccaaagaacatta

SEQ ID NO: 123336 - DNA, 25 bp, Homo sapien
tttttacacttttttggttcaagtt

SEQ ID NO: 123337 - DNA, 25 bp, Homo sapien
tttttacacttttttgtttcaagtt

SEQ ID NO: 123338 - DNA, 25 bp, Homo sapien
tttttacagagaccaaagaacatta

SEQ ID NO: 123339 - DNA, 25 bp, Homo sapien
tttttacagtattgcaaacctagat

SEQ ID NO: 123340 - DNA, 25 bp, Homo sapien
tttttacattattgcaaacctagat

SEQ ID NO: 123341 - DNA, 25 bp, Homo sapien
tttttagacgatattgcatttagat

SEQ ID NO: 123342 - DNA, 25 bp, Homo sapien
tttttagactccacagcttcgctcc

SEQ ID NO: 123343 - DNA, 25 bp, Homo sapien
tttttagactccgcagcttcgctcc

SEQ ID NO: 123344 - DNA, 25 bp, Homo sapien
tttttagatcaggctggttaggcag

SEQ ID NO: 123345 - DNA, 25 bp, Homo sapien
tttttagatcaggttggttaggcag

SEQ ID NO: 123346 - DNA, 25 bp, Homo sapien
tttttagatgatattgcatttagat

SEQ ID NO: 123347 - DNA, 25 bp, Homo sapien
tttttagcaacacggctagtaaata

SEQ ID NO: 123348 - DNA, 25 bp, Homo sapien
tttttagcaacatggctagtaaata

SEQ ID NO: 123349 - DNA, 25 bp, Homo sapien
tttttaggatcagttgtccttgtgc

SEQ ID NO: 123350 - DNA, 25 bp, Homo sapien
tttttaggatcggttgtccttgtgc

SEQ ID NO: 123351 - DNA, 25 bp, Homo sapien
tttttaggcttattactttcacagg

SEQ ID NO: 123352 - DNA, 25 bp, Homo sapien
tttttaggtgttgaataaatgagtc

SEQ ID NO: 123353 - DNA, 25 bp, Homo sapien
tttttaggtgttggataaatgagtc

SEQ ID NO: 123354 - DNA, 25 bp, Homo sapien
tttttaggtttattactttcacagg

SEQ ID NO: 123355 - DNA, 25 bp, Homo sapien
tttttagtaaatatcactggttctc

SEQ ID NO: 123356 - DNA, 25 bp, Homo sapien
tttttagtaaatatcattggttctc

SEQ ID NO: 123357 - DNA, 25 bp, Homo sapien
tttttagtcacttgttaaaaaggtg

SEQ ID NO: 123358 - DNA, 25 bp, Homo sapien
tttttagtcgcttgttaaaaaggtg

SEQ ID NO: 123359 - DNA, 25 bp, Homo sapien
tttttagtggtaggtgaagtacttt

SEQ ID NO: 123360 - DNA, 25 bp, Homo sapien
tttttagtggtatgtgaagtacttt

SEQ ID NO: 123361 - DNA, 25 bp, Homo sapien
tttttataaaggccttgagcatcca

SEQ ID NO: 123362 - DNA, 25 bp, Homo sapien
tttttataaatgttgaacacgatca

SEQ ID NO: 123363 - DNA, 25 bp, Homo sapien
tttttataaattttgaacacgatca

SEQ ID NO: 123364 - DNA, 25 bp, Homo sapien
tttttataagggccttgagcatcca

SEQ ID NO: 123365 - DNA, 25 bp, Homo sapien
tttttatagcttggcggtatgtttg

SEQ ID NO: 123366 - DNA, 25 bp, Homo sapien
tttttatagcttggtggtatgtttg

SEQ ID NO: 123367 - DNA, 25 bp, Homo sapien
tttttatccagaggcgtggacttag

SEQ ID NO: 123368 - DNA, 25 bp, Homo sapien
tttttatccagaggtgtggacttag

SEQ ID NO: 123369 - DNA, 25 bp, Homo sapien
tttttatccagttgttctcaaggga

SEQ ID NO: 123370 - DNA, 25 bp, Homo sapien
tttttatccatcttccttcatttgt

SEQ ID NO: 123371 - DNA, 25 bp, Homo sapien
tttttatccggttgttctcaaggga

SEQ ID NO: 123372 - DNA, 25 bp, Homo sapien
tttttatcctcttgttcttccacag

SEQ ID NO: 123373 - DNA, 25 bp, Homo sapien
tttttatcctctttttcttccacag

SEQ ID NO: 123374 - DNA, 25 bp, Homo sapien
tttttatccttcttccttcatttgt

SEQ ID NO: 123375 - DNA, 25 bp, Homo sapien
tttttatgatctgagtattcactgg

SEQ ID NO: 123376 - DNA, 25 bp, Homo sapien
tttttatgatctgtgtattcactgg

SEQ ID NO: 123377 - DNA, 25 bp, Homo sapien
tttttatgcgtggattctttttatc

SEQ ID NO: 123378 - DNA, 25 bp, Homo sapien
tttttatggtaaaagcaatgtaggc

SEQ ID NO: 123379 - DNA, 25 bp, Homo sapien
tttttatggtaaaggcaatgtaggc

SEQ ID NO: 123380 - DNA, 25 bp, Homo sapien
tttttatgtggctaacttcaataag

SEQ ID NO: 123381 - DNA, 25 bp, Homo sapien
tttttatgtggttaacttcaataag

SEQ ID NO: 123382 - DNA, 25 bp, Homo sapien
tttttatgtgtggattctttttatc

SEQ ID NO: 123383 - DNA, 25 bp, Homo sapien
tttttattcaacgggttcacaagtt

SEQ ID NO: 123384 - DNA, 25 bp, Homo sapien
tttttattcaacgtgttcacaagtt

SEQ ID NO: 123385 - DNA, 25 bp, Homo sapien
tttttatttattttcctgtatcagt

SEQ ID NO: 123386 - DNA, 25 bp, Homo sapien
tttttatttatttttctgtatcagt

SEQ ID NO: 123387 - DNA, 25 bp, Homo sapien
tttttatttccctcctatgttgatt

SEQ ID NO: 123388 - DNA, 25 bp, Homo sapien
tttttattttccattcccattctta

SEQ ID NO: 123389 - DNA, 25 bp, Homo sapien
tttttattttccgttcccattctta

SEQ ID NO: 123390 - DNA, 25 bp, Homo sapien
tttttattttcctcctatgttgatt

SEQ ID NO: 123391 - DNA, 25 bp, Homo sapien
tttttatttttcataccctgctctc

SEQ ID NO: 123392 - DNA, 25 bp, Homo sapien
tttttatttttcatacgctgctctc

SEQ ID NO: 123393 - DNA, 25 bp, Homo sapien
tttttcaaaatcaactatttcaagt

SEQ ID NO: 123394 - DNA, 25 bp, Homo sapien
tttttcaaaatcagctatttcaagt

SEQ ID NO: 123395 - DNA, 25 bp, Homo sapien
tttttcaaaattcagtaacttgccc

SEQ ID NO: 123396 - DNA, 25 bp, Homo sapien
tttttcaaagttcagtaacttgccc

SEQ ID NO: 123397 - DNA, 25 bp, Homo sapien
tttttcaaatacaaatcgacaatcc

SEQ ID NO: 123398 - DNA, 25 bp, Homo sapien
tttttcaaatacaaattgacaatcc

SEQ ID NO: 123399 - DNA, 25 bp, Homo sapien
tttttcaagcacttcaaacttcata

SEQ ID NO: 123400 - DNA, 25 bp, Homo sapien
tttttcaagcactttaaacttcata

SEQ ID NO: 123401 - DNA, 25 bp, Homo sapien
tttttcaagccctgcagatcttttt

SEQ ID NO: 123402 - DNA, 25 bp, Homo sapien
tttttcaagccctgcatatcttttt

SEQ ID NO: 123403 - DNA, 25 bp, Homo sapien
tttttcaatcagccacaagctttca

SEQ ID NO: 123404 - DNA, 25 bp, Homo sapien
tttttcaatcagccgcaagctttca

SEQ ID NO: 123405 - DNA, 25 bp, Homo sapien
tttttcacaagtttccaagtggtgc

SEQ ID NO: 123406 - DNA, 25 bp, Homo sapien
tttttcacaagtttcccagtggtgc

SEQ ID NO: 123407 - DNA, 25 bp, Homo sapien
tttttcactttgaatatctaggtag

SEQ ID NO: 123408 - DNA, 25 bp, Homo sapien
tttttcactttggatatctaggtag

SEQ ID NO: 123409 - DNA, 25 bp, Homo sapien
tttttcagcaaaaccctaagactcc

SEQ ID NO: 123410 - DNA, 25 bp, Homo sapien
tttttcagcagtcattttcttcaat

SEQ ID NO: 123411 - DNA, 25 bp, Homo sapien
tttttcagcagtctttttcttcaat

SEQ ID NO: 123412 - DNA, 25 bp, Homo sapien
tttttcagcgaaaccctaagactcc

SEQ ID NO: 123413 - DNA, 25 bp, Homo sapien
tttttcagtattaaaataggctgga

SEQ ID NO: 123414 - DNA, 25 bp, Homo sapien
tttttcagtattaacataggctgga

SEQ ID NO: 123415 - DNA, 25 bp, Homo sapien
tttttcatttacgttgaatgcaatg

SEQ ID NO: 123416 - DNA, 25 bp, Homo sapien
tttttcatttatgttgaatgcaatg

SEQ ID NO: 123417 - DNA, 25 bp, Homo sapien
tttttccaaaacgcgtaaatcatct

SEQ ID NO: 123418 - DNA, 25 bp, Homo sapien
tttttccaaaacgtgtaaatcatct

SEQ ID NO: 123419 - DNA, 25 bp, Homo sapien
tttttccaagttagtttctgaaaag

SEQ ID NO: 123420 - DNA, 25 bp, Homo sapien
tttttccacgttagtttctgaaaag

SEQ ID NO: 123421 - DNA, 25 bp, Homo sapien
tttttccatccttaaagacagaata

SEQ ID NO: 123422 - DNA, 25 bp, Homo sapien
tttttccatccttaaatacagaata

SEQ ID NO: 123423 - DNA, 25 bp, Homo sapien
tttttcccatacttcatcccagaac

SEQ ID NO: 123424 - DNA, 25 bp, Homo sapien
tttttcccgtacttcatcccagaac

SEQ ID NO: 123425 - DNA, 25 bp, Homo sapien
tttttccctacagaatgattgagtc

SEQ ID NO: 123426 - DNA, 25 bp, Homo sapien
tttttcccttcagaatgattgagtc

SEQ ID NO: 123427 - DNA, 25 bp, Homo sapien
tttttccgcattgttttctagcccc

SEQ ID NO: 123428 - DNA, 25 bp, Homo sapien
tttttccgtattgttttctagcccc

SEQ ID NO: 123429 - DNA, 25 bp, Homo sapien
tttttcctggtctttcaaagccatc

SEQ ID NO: 123430 - DNA, 25 bp, Homo sapien
tttttcctggtctttcgaagccatc

SEQ ID NO: 123431 - DNA, 25 bp, Homo sapien
tttttccttgacacgctaccgctag

SEQ ID NO: 123432 - DNA, 25 bp, Homo sapien
tttttccttgacatgctaccgctag

SEQ ID NO: 123433 - DNA, 25 bp, Homo sapien
tttttcgcccacagcaagaaattca

SEQ ID NO: 123434 - DNA, 25 bp, Homo sapien
tttttcgcctacagcaagaaattca

SEQ ID NO: 123435 - DNA, 25 bp, Homo sapien
tttttcgtatgactttcggttcttt

SEQ ID NO: 123436 - DNA, 25 bp, Homo sapien
tttttcgtatgacttttggttcttt

SEQ ID NO: 123437 - DNA, 25 bp, Homo sapien
tttttctacaaatatgatcatagag

SEQ ID NO: 123438 - DNA, 25 bp, Homo sapien
tttttctataaatatgatcatagag

SEQ ID NO: 123439 - DNA, 25 bp, Homo sapien
tttttctcattgactggtgtggatt

SEQ ID NO: 123440 - DNA, 25 bp, Homo sapien
tttttctcctgaatgaaaccaccat

SEQ ID NO: 123441 - DNA, 25 bp, Homo sapien
tttttctcctgagtgaaaccaccat

SEQ ID NO: 123442 - DNA, 25 bp, Homo sapien
tttttctcgttgactggtgtggatt

SEQ ID NO: 123443 - DNA, 25 bp, Homo sapien
tttttctgaacgtgtacaactgaaa

SEQ ID NO: 123444 - DNA, 25 bp, Homo sapien
tttttctgaacgtgtataactgaaa

SEQ ID NO: 123445 - DNA, 25 bp, Homo sapien
tttttctgaatacgttcaatgcatg

SEQ ID NO: 123446 - DNA, 25 bp, Homo sapien
tttttctgaatatgttcaatgcatg

SEQ ID NO: 123447 - DNA, 25 bp, Homo sapien
tttttctgataccacaccctggtct

SEQ ID NO: 123448 - DNA, 25 bp, Homo sapien
tttttctgatatcacaccctggtct

SEQ ID NO: 123449 - DNA, 25 bp, Homo sapien
tttttctgcaataatgtaataatag

SEQ ID NO: 123450 - DNA, 25 bp, Homo sapien
tttttctgcaatagtgtaataatag

SEQ ID NO: 123451 - DNA, 25 bp, Homo sapien
tttttctgcagtgattcagcaatta

SEQ ID NO: 123452 - DNA, 25 bp, Homo sapien
tttttctgcatagattcagatgatt

SEQ ID NO: 123453 - DNA, 25 bp, Homo sapien
tttttctgcatggattcagatgatt

SEQ ID NO: 123454 - DNA, 25 bp, Homo sapien
tttttctgcgcagctcatcaatatt

SEQ ID NO: 123455 - DNA, 25 bp, Homo sapien
tttttctgcggtgattcagcaatta

SEQ ID NO: 123456 - DNA, 25 bp, Homo sapien
tttttctgctaaaaggaaaggccac

SEQ ID NO: 123457 - DNA, 25 bp, Homo sapien
tttttctgctaacaggaaaggccac

SEQ ID NO: 123458 - DNA, 25 bp, Homo sapien
tttttctgctcagctcatcaatatt

SEQ ID NO: 123459 - DNA, 25 bp, Homo sapien
tttttctgggagactgttccctatt

SEQ ID NO: 123460 - DNA, 25 bp, Homo sapien
tttttctgggagagtgttccctatt

SEQ ID NO: 123461 - DNA, 25 bp, Homo sapien
tttttctgtcaagcagatggtgagg

SEQ ID NO: 123462 - DNA, 25 bp, Homo sapien
tttttctgtcaagtagatggtgagg

SEQ ID NO: 123463 - DNA, 25 bp, Homo sapien
tttttcttacaccatctcagtctct

SEQ ID NO: 123464 - DNA, 25 bp, Homo sapien
tttttcttagctactaaaatctgtt

SEQ ID NO: 123465 - DNA, 25 bp, Homo sapien
tttttcttagctgctaaaatctgtt

SEQ ID NO: 123466 - DNA, 25 bp, Homo sapien
tttttcttataccatctcagtctct

SEQ ID NO: 123467 - DNA, 25 bp, Homo sapien
tttttcttctcccgaatgcatttac

SEQ ID NO: 123468 - DNA, 25 bp, Homo sapien
tttttcttctcctgaatgcatttac

SEQ ID NO: 123469 - DNA, 25 bp, Homo sapien
tttttcttggtgttggtgctggtag

SEQ ID NO: 123470 - DNA, 25 bp, Homo sapien
tttttcttggtgtttgtgctggtag

SEQ ID NO: 123471 - DNA, 25 bp, Homo sapien
tttttctttcagatatcagctcaag

SEQ ID NO: 123472 - DNA, 25 bp, Homo sapien
tttttctttgccaaataaggtaaca

SEQ ID NO: 123473 - DNA, 25 bp, Homo sapien
tttttctttgccaagtaaggtaaca

SEQ ID NO: 123474 - DNA, 25 bp, Homo sapien
tttttcttttagatatcagctcaag

SEQ ID NO: 123475 - DNA, 25 bp, Homo sapien
tttttcttttagctcccacacgtga

SEQ ID NO: 123476 - DNA, 25 bp, Homo sapien
tttttcttttagttcccacacgtga

SEQ ID NO: 123477 - DNA, 25 bp, Homo sapien
tttttgaaaatacggtctctgttct

SEQ ID NO: 123478 - DNA, 25 bp, Homo sapien
tttttgaaaatgacgtgctaagtct

SEQ ID NO: 123479 - DNA, 25 bp, Homo sapien
tttttgaaaatgatgtgctaagtct

SEQ ID NO: 123480 - DNA, 25 bp, Homo sapien
tttttgaaatgctaaataaacactg

SEQ ID NO: 123481 - DNA, 25 bp, Homo sapien
tttttgaaatggtaaataaacactg

SEQ ID NO: 123482 - DNA, 25 bp, Homo sapien
tttttgaactgcatattttatgact

SEQ ID NO: 123483 - DNA, 25 bp, Homo sapien
tttttgaagatacggtctctgttct

SEQ ID NO: 123484 - DNA, 25 bp, Homo sapien
tttttgaatagcagggaaccatagc

SEQ ID NO: 123485 - DNA, 25 bp, Homo sapien
tttttgaatagcaggggaccatagc

SEQ ID NO: 123486 - DNA, 25 bp, Homo sapien
tttttgaatgcatataaagcactta

SEQ ID NO: 123487 - DNA, 25 bp, Homo sapien
tttttgaatgcatgtaaagcactta

SEQ ID NO: 123488 - DNA, 25 bp, Homo sapien
tttttgaattgcatattttatgact

SEQ ID NO: 123489 - DNA, 25 bp, Homo sapien
tttttgacagattttaatgaagaaa

SEQ ID NO: 123490 - DNA, 25 bp, Homo sapien
tttttgacccgtcactggttgaatc

SEQ ID NO: 123491 - DNA, 25 bp, Homo sapien
tttttgacccgtcattggttgaatc

SEQ ID NO: 123492 - DNA, 25 bp, Homo sapien
tttttgaccgccttggcttgtagat

SEQ ID NO: 123493 - DNA, 25 bp, Homo sapien
tttttgaccgcctttgcttgtagat

SEQ ID NO: 123494 - DNA, 25 bp, Homo sapien
tttttgacggattttaatgaagaaa

SEQ ID NO: 123495 - DNA, 25 bp, Homo sapien
tttttgactaccgtccagagtttct

SEQ ID NO: 123496 - DNA, 25 bp, Homo sapien
tttttgactactgtccagagtttct

SEQ ID NO: 123497 - DNA, 25 bp, Homo sapien
tttttgagtgcggatgtaaatgata

SEQ ID NO: 123498 - DNA, 25 bp, Homo sapien
tttttgagtgctgatgtaaatgata

SEQ ID NO: 123499 - DNA, 25 bp, Homo sapien
tttttgatattaaaagcacaaatgc

SEQ ID NO: 123500 - DNA, 25 bp, Homo sapien
tttttgatcatgattcctgagaaat

SEQ ID NO: 123501 - DNA, 25 bp, Homo sapien
tttttgatcatgattcttgagaaat

SEQ ID NO: 123502 - DNA, 25 bp, Homo sapien
tttttgatgggacatggctgcctag

SEQ ID NO: 123503 - DNA, 25 bp, Homo sapien
tttttgatgggacttggctgcctag

SEQ ID NO: 123504 - DNA, 25 bp, Homo sapien
tttttgatgttaaaagcacaaatgc

SEQ ID NO: 123505 - DNA, 25 bp, Homo sapien
tttttgcaagaaggcacaatttaat

SEQ ID NO: 123506 - DNA, 25 bp, Homo sapien
tttttgcaagaaggcataatttaat

SEQ ID NO: 123507 - DNA, 25 bp, Homo sapien
tttttgcaattagccgaacacgtag

SEQ ID NO: 123508 - DNA, 25 bp, Homo sapien
tttttgcaattagctgaacacgtag

SEQ ID NO: 123509 - DNA, 25 bp, Homo sapien
tttttgcaccaatgagggacacgag

SEQ ID NO: 123510 - DNA, 25 bp, Homo sapien
tttttgcacgaatgagggacacgag

SEQ ID NO: 123511 - DNA, 25 bp, Homo sapien
tttttgcaggccttaagtatggcag

SEQ ID NO: 123512 - DNA, 25 bp, Homo sapien
tttttgcaggccttgagtatggcag

SEQ ID NO: 123513 - DNA, 25 bp, Homo sapien
tttttgcagtgcatttattcattca

SEQ ID NO: 123514 - DNA, 25 bp, Homo sapien
tttttgcatctgtgccggcagtttt

SEQ ID NO: 123515 - DNA, 25 bp, Homo sapien
tttttgcatctgtgcctgcagtttt

SEQ ID NO: 123516 - DNA, 25 bp, Homo sapien
tttttgcattgcatttattcattca

SEQ ID NO: 123517 - DNA, 25 bp, Homo sapien
tttttgcctcagtttatattagtca

SEQ ID NO: 123518 - DNA, 25 bp, Homo sapien
tttttgcctcattttatattagtca

SEQ ID NO: 123519 - DNA, 25 bp, Homo sapien
tttttgctaagcgtcaataaacagc

SEQ ID NO: 123520 - DNA, 25 bp, Homo sapien
tttttgctaagcgtcagtaaacagc

SEQ ID NO: 123521 - DNA, 25 bp, Homo sapien
tttttgctagacagaactatctgat

SEQ ID NO: 123522 - DNA, 25 bp, Homo sapien
tttttgctctggctttcgcaacatc

SEQ ID NO: 123523 - DNA, 25 bp, Homo sapien
tttttgctctggcttttgcaacatc

SEQ ID NO: 123524 - DNA, 25 bp, Homo sapien
tttttgctgaaggaatttttattac

SEQ ID NO: 123525 - DNA, 25 bp, Homo sapien
tttttgctggacagaactatctgat

SEQ ID NO: 123526 - DNA, 25 bp, Homo sapien
tttttgctggaggaatttttattac

SEQ ID NO: 123527 - DNA, 25 bp, Homo sapien
tttttgctgtttgatttatatgaaa

SEQ ID NO: 123528 - DNA, 25 bp, Homo sapien
tttttgctgtttgttttatatgaaa

SEQ ID NO: 123529 - DNA, 25 bp, Homo sapien
tttttgcttcagttttgtgttagtt

SEQ ID NO: 123530 - DNA, 25 bp, Homo sapien
tttttgcttctccctgaaaaaaagc

SEQ ID NO: 123531 - DNA, 25 bp, Homo sapien
tttttgcttctccctgcaaaaaagc

SEQ ID NO: 123532 - DNA, 25 bp, Homo sapien
tttttgcttgagttttgtgttagtt

SEQ ID NO: 123533 - DNA, 25 bp, Homo sapien
tttttgctttaagttcagctctcaa

SEQ ID NO: 123534 - DNA, 25 bp, Homo sapien
tttttgctttaagttcggctctcaa

SEQ ID NO: 123535 - DNA, 25 bp, Homo sapien
tttttggacagggtcgtgtgatggt

SEQ ID NO: 123536 - DNA, 25 bp, Homo sapien
tttttggacagggttgtgtgatggt

SEQ ID NO: 123537 - DNA, 25 bp, Homo sapien
tttttggacatatccttactgttca

SEQ ID NO: 123538 - DNA, 25 bp, Homo sapien
tttttggacatgtccttactgttca

SEQ ID NO: 123539 - DNA, 25 bp, Homo sapien
tttttggatttgtgaaagatggcta

SEQ ID NO: 123540 - DNA, 25 bp, Homo sapien
tttttggatttgtgaacgatggcta

SEQ ID NO: 123541 - DNA, 25 bp, Homo sapien
tttttggcagttaccctttgtcaag

SEQ ID NO: 123542 - DNA, 25 bp, Homo sapien
tttttggcagttactctttgtcaag

SEQ ID NO: 123543 - DNA, 25 bp, Homo sapien
tttttggcatcatacaataagtgac

SEQ ID NO: 123544 - DNA, 25 bp, Homo sapien
tttttggcatcatataataagtgac

SEQ ID NO: 123545 - DNA, 25 bp, Homo sapien
tttttggcattcatttccctttctt

SEQ ID NO: 123546 - DNA, 25 bp, Homo sapien
tttttggcattcgtttccctttctt

SEQ ID NO: 123547 - DNA, 25 bp, Homo sapien
tttttggccattacgttattgtcca

SEQ ID NO: 123548 - DNA, 25 bp, Homo sapien
tttttggccattatgttattgtcca

SEQ ID NO: 123549 - DNA, 25 bp, Homo sapien
tttttggccttgatatttttctgtc

SEQ ID NO: 123550 - DNA, 25 bp, Homo sapien
tttttggccttgctatttttctgtc

SEQ ID NO: 123551 - DNA, 25 bp, Homo sapien
tttttgggaggtaatgcaagaaaac

SEQ ID NO: 123552 - DNA, 25 bp, Homo sapien
tttttgggaggtagtgcaagaaaac

SEQ ID NO: 123553 - DNA, 25 bp, Homo sapien
tttttgtaacaagcctacctactga

SEQ ID NO: 123554 - DNA, 25 bp, Homo sapien
tttttgtaacaagccttcctactga

SEQ ID NO: 123555 - DNA, 25 bp, Homo sapien
tttttgtaggtcaattatacctcag

SEQ ID NO: 123556 - DNA, 25 bp, Homo sapien
tttttgtatgtcaattatacctcag

SEQ ID NO: 123557 - DNA, 25 bp, Homo sapien
tttttgtcaatccataatctgatag

SEQ ID NO: 123558 - DNA, 25 bp, Homo sapien
tttttgtcaatccgtaatctgatag

SEQ ID NO: 123559 - DNA, 25 bp, Homo sapien
tttttgtctttatcgtttgttagag

SEQ ID NO: 123560 - DNA, 25 bp, Homo sapien
tttttgtctttatcttttgttagag

SEQ ID NO: 123561 - DNA, 25 bp, Homo sapien
tttttgtgcaacatcggtgcagttt

SEQ ID NO: 123562 - DNA, 25 bp, Homo sapien
tttttgtgcaacattggtgcagttt

SEQ ID NO: 123563 - DNA, 25 bp, Homo sapien
tttttgtgcgagcctctgagatttt

SEQ ID NO: 123564 - DNA, 25 bp, Homo sapien
tttttgtgtaagataaatttccatc

SEQ ID NO: 123565 - DNA, 25 bp, Homo sapien
tttttgtgtaagttaaatttccatc

SEQ ID NO: 123566 - DNA, 25 bp, Homo sapien
tttttgtgtgagcctctgagatttt

SEQ ID NO: 123567 - DNA, 25 bp, Homo sapien
tttttgtgtttcttataatgcaaca

SEQ ID NO: 123568 - DNA, 25 bp, Homo sapien
tttttgtgtttgttataatgcaaca

SEQ ID NO: 123569 - DNA, 25 bp, Homo sapien
tttttgtttagtaatgatgccttgc

SEQ ID NO: 123570 - DNA, 25 bp, Homo sapien
tttttgtttagtattgatgccttgc

SEQ ID NO: 123571 - DNA, 25 bp, Homo sapien
tttttgtttccctggttttctacta

SEQ ID NO: 123572 - DNA, 25 bp, Homo sapien
tttttgtttccctgtttttctacta

SEQ ID NO: 123573 - DNA, 25 bp, Homo sapien
tttttgtttttatagaggcggagtt

SEQ ID NO: 123574 - DNA, 25 bp, Homo sapien
tttttgtttttattgaggcggagtt

SEQ ID NO: 123575 - DNA, 25 bp, Homo sapien
ttttttaaagagtaatgttctcatc

SEQ ID NO: 123576 - DNA, 25 bp, Homo sapien
ttttttaaagagtagtgttctcatc

SEQ ID NO: 123577 - DNA, 25 bp, Homo sapien
ttttttaacaagtgccgtgatttcc

SEQ ID NO: 123578 - DNA, 25 bp, Homo sapien
ttttttaataagtgccgtgatttcc

SEQ ID NO: 123579 - DNA, 25 bp, Homo sapien
ttttttagaagactgacattgcatt

SEQ ID NO: 123580 - DNA, 25 bp, Homo sapien
ttttttagaagactgatattgcatt

SEQ ID NO: 123581 - DNA, 25 bp, Homo sapien
ttttttaggatcagttgtccttgtg

SEQ ID NO: 123582 - DNA, 25 bp, Homo sapien
ttttttaggatcggttgtccttgtg

SEQ ID NO: 123583 - DNA, 25 bp, Homo sapien
ttttttaggtctacaaacactgaat

SEQ ID NO: 123584 - DNA, 25 bp, Homo sapien
ttttttaggtctacaagcactgaat

SEQ ID NO: 123585 - DNA, 25 bp, Homo sapien
ttttttatagtgcacatcccctaag

SEQ ID NO: 123586 - DNA, 25 bp, Homo sapien
ttttttatagtgcatatcccctaag

SEQ ID NO: 123587 - DNA, 25 bp, Homo sapien
ttttttatttgtagaactgaggtaa

SEQ ID NO: 123588 - DNA, 25 bp, Homo sapien
ttttttatttgtagaattgaggtaa

SEQ ID NO: 123589 - DNA, 25 bp, Homo sapien
ttttttcatttacgttgaatgcaat

SEQ ID NO: 123590 - DNA, 25 bp, Homo sapien
ttttttcatttatgttgaatgcaat

SEQ ID NO: 123591 - DNA, 25 bp, Homo sapien
ttttttccaaaacgcgtaaatcatc

SEQ ID NO: 123592 - DNA, 25 bp, Homo sapien
ttttttccaaaacgtgtaaatcatc

SEQ ID NO: 123593 - DNA, 25 bp, Homo sapien
ttttttccaagttagtttctgaaaa

SEQ ID NO: 123594 - DNA, 25 bp, Homo sapien
ttttttccacgttagtttctgaaaa

SEQ ID NO: 123595 - DNA, 25 bp, Homo sapien
ttttttcccagactatttttgacct

SEQ ID NO: 123596 - DNA, 25 bp, Homo sapien
ttttttcccaggctatttttgacct

SEQ ID NO: 123597 - DNA, 25 bp, Homo sapien
ttttttcccttaccagtccggcgtt

SEQ ID NO: 123598 - DNA, 25 bp, Homo sapien
ttttttcccttatcagtccggcgtt

SEQ ID NO: 123599 - DNA, 25 bp, Homo sapien
ttttttcctatagcaattatcaccc

SEQ ID NO: 123600 - DNA, 25 bp, Homo sapien
ttttttcctgtagcaattatcaccc

SEQ ID NO: 123601 - DNA, 25 bp, Homo sapien
ttttttctccaagcctcatcctcct

SEQ ID NO: 123602 - DNA, 25 bp, Homo sapien
ttttttctctaagcctcatcctcct

SEQ ID NO: 123603 - DNA, 25 bp, Homo sapien
ttttttctgcatagattcagatgat

SEQ ID NO: 123604 - DNA, 25 bp, Homo sapien
ttttttctgcatggattcagatgat

SEQ ID NO: 123605 - DNA, 25 bp, Homo sapien
ttttttgaaaatgacgtgctaagtc

SEQ ID NO: 123606 - DNA, 25 bp, Homo sapien
ttttttgaaaatgatgtgctaagtc

SEQ ID NO: 123607 - DNA, 25 bp, Homo sapien
ttttttgaatgcatataaagcactt

SEQ ID NO: 123608 - DNA, 25 bp, Homo sapien
ttttttgaatgcatgtaaagcactt

SEQ ID NO: 123609 - DNA, 25 bp, Homo sapien
ttttttgactaccgtccagagtttc

SEQ ID NO: 123610 - DNA, 25 bp, Homo sapien
ttttttgactactgtccagagtttc

SEQ ID NO: 123611 - DNA, 25 bp, Homo sapien
ttttttgagaccgaattttgctcgt

SEQ ID NO: 123612 - DNA, 25 bp, Homo sapien
ttttttgagactgaattttgctcgt

SEQ ID NO: 123613 - DNA, 25 bp, Homo sapien
ttttttgagcacgtcattactttct

SEQ ID NO: 123614 - DNA, 25 bp, Homo sapien
ttttttgagcatgtcattactttct

SEQ ID NO: 123615 - DNA, 25 bp, Homo sapien
ttttttgagtgcggatgtaaatgat

SEQ ID NO: 123616 - DNA, 25 bp, Homo sapien
ttttttgagtgctgatgtaaatgat

SEQ ID NO: 123617 - DNA, 25 bp, Homo sapien
ttttttgatgcatttgggtaagtaa

SEQ ID NO: 123618 - DNA, 25 bp, Homo sapien
ttttttgatgcgtttgggtaagtaa

SEQ ID NO: 123619 - DNA, 25 bp, Homo sapien
ttttttgcagagatggcttcacatt

SEQ ID NO: 123620 - DNA, 25 bp, Homo sapien
ttttttgccgagatggcttcacatt

SEQ ID NO: 123621 - DNA, 25 bp, Homo sapien
ttttttgcggcacacagaagaaata

SEQ ID NO: 123622 - DNA, 25 bp, Homo sapien
ttttttgctagacagaactatctga

SEQ ID NO: 123623 - DNA, 25 bp, Homo sapien
ttttttgctctatacccatcaaatt

SEQ ID NO: 123624 - DNA, 25 bp, Homo sapien
ttttttgctctctacccatcaaatt

SEQ ID NO: 123625 - DNA, 25 bp, Homo sapien
ttttttgctgcacacagaagaaata

SEQ ID NO: 123626 - DNA, 25 bp, Homo sapien
ttttttgctggacagaactatctga

SEQ ID NO: 123627 - DNA, 25 bp, Homo sapien
ttttttggatgcgaatggaatgggc

SEQ ID NO: 123628 - DNA, 25 bp, Homo sapien
ttttttggatgtgaatggaatgggc

SEQ ID NO: 123629 - DNA, 25 bp, Homo sapien
ttttttggcattcatttccctttct

SEQ ID NO: 123630 - DNA, 25 bp, Homo sapien
ttttttggcattcgtttccctttct

SEQ ID NO: 123631 - DNA, 25 bp, Homo sapien
ttttttgggaggtaatgcaagaaaa

SEQ ID NO: 123632 - DNA, 25 bp, Homo sapien
ttttttgggaggtagtgcaagaaaa

SEQ ID NO: 123633 - DNA, 25 bp, Homo sapien
ttttttgtacctagttctatggtta

SEQ ID NO: 123634 - DNA, 25 bp, Homo sapien
ttttttgtacctggttctatggtta

SEQ ID NO: 123635 - DNA, 25 bp, Homo sapien
ttttttgtaggtcaattatacctca

SEQ ID NO: 123636 - DNA, 25 bp, Homo sapien
ttttttgtatgtcaattatacctca

SEQ ID NO: 123637 - DNA, 25 bp, Homo sapien
ttttttgtctcatggttacattatg

SEQ ID NO: 123638 - DNA, 25 bp, Homo sapien
ttttttgtctcgtggttacattatg

SEQ ID NO: 123639 - DNA, 25 bp, Homo sapien
ttttttgtgcgagcctctgagattt

SEQ ID NO: 123640 - DNA, 25 bp, Homo sapien
ttttttgtggcaaagaagatcacaa

SEQ ID NO: 123641 - DNA, 25 bp, Homo sapien
ttttttgtggcaaagaggatcacaa

SEQ ID NO: 123642 - DNA, 25 bp, Homo sapien
ttttttgtggtcttcagtaagttgt

SEQ ID NO: 123643 - DNA, 25 bp, Homo sapien
ttttttgtggtctttagtaagttgt

SEQ ID NO: 123644 - DNA, 25 bp, Homo sapien
ttttttgtgtgagcctctgagattt

SEQ ID NO: 123645 - DNA, 25 bp, Homo sapien
ttttttgtttttatagaggcggagt

SEQ ID NO: 123646 - DNA, 25 bp, Homo sapien
ttttttgtttttattgaggcggagt

SEQ ID NO: 123647 - DNA, 25 bp, Homo sapien
tttttttcaaaattcagtaacttgc

SEQ ID NO: 123648 - DNA, 25 bp, Homo sapien
tttttttcaaagttcagtaacttgc

SEQ ID NO: 123649 - DNA, 25 bp, Homo sapien
tttttttcaatcagccacaagcttt

SEQ ID NO: 123650 - DNA, 25 bp, Homo sapien
tttttttcaatcagccgcaagcttt

SEQ ID NO: 123651 - DNA, 25 bp, Homo sapien
tttttttcatggaagataagttgaa

SEQ ID NO: 123652 - DNA, 25 bp, Homo sapien
tttttttcatgggagataagttgaa

SEQ ID NO: 123653 - DNA, 25 bp, Homo sapien
tttttttcatttccttgtgttttgt

SEQ ID NO: 123654 - DNA, 25 bp, Homo sapien
tttttttcccagactatttttgacc

SEQ ID NO: 123655 - DNA, 25 bp, Homo sapien
tttttttcccaggctatttttgacc

SEQ ID NO: 123656 - DNA, 25 bp, Homo sapien
tttttttcccttaccagtccggcgt

SEQ ID NO: 123657 - DNA, 25 bp, Homo sapien
tttttttcccttatcagtccggcgt

SEQ ID NO: 123658 - DNA, 25 bp, Homo sapien
tttttttcgtttccttgtgttttgt

SEQ ID NO: 123659 - DNA, 25 bp, Homo sapien
tttttttcgttttaatccatgaaat

SEQ ID NO: 123660 - DNA, 25 bp, Homo sapien
tttttttctttttaatccatgaaat

SEQ ID NO: 123661 - DNA, 25 bp, Homo sapien
tttttttgaacaactacctttgtca

SEQ ID NO: 123662 - DNA, 25 bp, Homo sapien
tttttttgagcaactacctttgtca

SEQ ID NO: 123663 - DNA, 25 bp, Homo sapien
tttttttgagtgcggatgtaaatga

SEQ ID NO: 123664 - DNA, 25 bp, Homo sapien
tttttttgagtgctgatgtaaatga

SEQ ID NO: 123665 - DNA, 25 bp, Homo sapien
tttttttgcagagatggcttcacat

SEQ ID NO: 123666 - DNA, 25 bp, Homo sapien
tttttttgcaggccttaagtatggc

SEQ ID NO: 123667 - DNA, 25 bp, Homo sapien
tttttttgcaggccttgagtatggc

SEQ ID NO: 123668 - DNA, 25 bp, Homo sapien
tttttttgccgagatggcttcacat

SEQ ID NO: 123669 - DNA, 25 bp, Homo sapien
tttttttgcggcacacagaagaaat

SEQ ID NO: 123670 - DNA, 25 bp, Homo sapien
tttttttgctgcacacagaagaaat

SEQ ID NO: 123671 - DNA, 25 bp, Homo sapien
tttttttgtacctagttctatggtt

SEQ ID NO: 123672 - DNA, 25 bp, Homo sapien
tttttttgtacctggttctatggtt

SEQ ID NO: 123673 - DNA, 25 bp, Homo sapien
tttttttgtctcatggttacattat

SEQ ID NO: 123674 - DNA, 25 bp, Homo sapien
tttttttgtctcgtggttacattat

SEQ ID NO: 123675 - DNA, 25 bp, Homo sapien
ttttttttccttgtgtgtgtgtggc

SEQ ID NO: 123676 - DNA, 25 bp, Homo sapien
ttttttttctccaagcctcatcctc

SEQ ID NO: 123677 - DNA, 25 bp, Homo sapien
ttttttttctctaagcctcatcctc

SEQ ID NO: 123678 - DNA, 25 bp, Homo sapien
ttttttttgaatgcatataaagcac

SEQ ID NO: 123679 - DNA, 25 bp, Homo sapien
ttttttttgaatgcatgtaaagcac

SEQ ID NO: 123680 - DNA, 25 bp, Homo sapien
ttttttttgtacctagttctatggt

SEQ ID NO: 123681 - DNA, 25 bp, Homo sapien
ttttttttgtacctggttctatggt

SEQ ID NO: 123682 - DNA, 25 bp, Homo sapien
tttttttttcttgtgtgtgtgtggc

SEQ ID NO: 123683 - DNA, 25 bp, Homo sapien
ttttttttttgtacctagttctatg

SEQ ID NO: 123684 - DNA, 25 bp, Homo sapien
ttttttttttgtacctggttctatg

SEQ ID NO: 123685 - DNA, 25 bp, Homo sapien
aaactggtagttgctttttccttaa

SEQ ID NO: 123686 - DNA, 25 bp, Homo sapien
aaactggtagtttctttttccttaa

SEQ ID NO: 123687 - DNA, 25 bp, Homo sapien
aaatgtgggaccacgaggacatcat

SEQ ID NO: 123688 - DNA, 25 bp, Homo sapien
aaatgtgggaccatgaggacatcat

SEQ ID NO: 123689 - DNA, 25 bp, Homo sapien
aaccccatctctactaaaaacacac

SEQ ID NO: 123690 - DNA, 25 bp, Homo sapien
aaccccatctctgctaaaaacacac

SEQ ID NO: 123691 - DNA, 25 bp, Homo sapien
aagcagaaactaaaaaaaaatagat

SEQ ID NO: 123692 - DNA, 25 bp, Homo sapien
aagcagaaactgaaaaaaaatagat

SEQ ID NO: 123693 - DNA, 25 bp, Homo sapien
aataaataggaatatgtgaatgata

SEQ ID NO: 123694 - DNA, 25 bp, Homo sapien
aataaataggaatgtgtgaatgata

SEQ ID NO: 123695 - DNA, 25 bp, Homo sapien
aataggaatatgtgaatgatacaca

SEQ ID NO: 123696 - DNA, 25 bp, Homo sapien
aataggaatgtgtgaatgatacaca

SEQ ID NO: 123697 - DNA, 25 bp, Homo sapien
aatatgccactaggatcccaaacct

SEQ ID NO: 123698 - DNA, 25 bp, Homo sapien
aatatgccgctaggatcccaaacct

SEQ ID NO: 123699 - DNA, 25 bp, Homo sapien
aatattttgctgagaatttttgcat

SEQ ID NO: 123700 - DNA, 25 bp, Homo sapien
aatattttgttgagaatttttgcat

SEQ ID NO: 123701 - DNA, 25 bp, Homo sapien
aatctacatgatccatgtttccaca

SEQ ID NO: 123702 - DNA, 25 bp, Homo sapien
aatctacatgatccctgtttccaca

SEQ ID NO: 123703 - DNA, 25 bp, Homo sapien
aatgagtatttgttcactttatttg

SEQ ID NO: 123704 - DNA, 25 bp, Homo sapien
aatgagtatttgttcattttatttg

SEQ ID NO: 123705 - DNA, 25 bp, Homo sapien
aatgtgggaccacgaggacatcata

SEQ ID NO: 123706 - DNA, 25 bp, Homo sapien
aatgtgggaccatgaggacatcata

SEQ ID NO: 123707 - DNA, 25 bp, Homo sapien
aatgtttgcatgtaaccatctttag

SEQ ID NO: 123708 - DNA, 25 bp, Homo sapien
aatgtttgcatgtagccatctttag

SEQ ID NO: 123709 - DNA, 25 bp, Homo sapien
aattagccaggcgttgcggcgcaca

SEQ ID NO: 123710 - DNA, 25 bp, Homo sapien
aattagccaggcgttgtggcgcaca

SEQ ID NO: 123711 - DNA, 25 bp, Homo sapien
acaagaaatgtgggaccacgaggac

SEQ ID NO: 123712 - DNA, 25 bp, Homo sapien
acaagaaatgtgtgaccacgaggac

SEQ ID NO: 123713 - DNA, 25 bp, Homo sapien
acacacgcacgccagtggtgaaaac

SEQ ID NO: 123714 - DNA, 25 bp, Homo sapien
acacacgcacgccagttgtgaaaac

SEQ ID NO: 123715 - DNA, 25 bp, Homo sapien
acacgcacgccagtggtgaaaacct

SEQ ID NO: 123716 - DNA, 25 bp, Homo sapien
acacgcacgccagttgtgaaaacct

SEQ ID NO: 123717 - DNA, 25 bp, Homo sapien
acattcatgagtaaaataataaaac

SEQ ID NO: 123718 - DNA, 25 bp, Homo sapien
acattcatgagtagaataataaaac

SEQ ID NO: 123719 - DNA, 25 bp, Homo sapien
accccatctctactaaaaacacaca

SEQ ID NO: 123720 - DNA, 25 bp, Homo sapien
accccatctctgctaaaaacacaca

SEQ ID NO: 123721 - DNA, 25 bp, Homo sapien
acgcacgccagtggtgaaaacctaa

SEQ ID NO: 123722 - DNA, 25 bp, Homo sapien
acgcacgccagttgtgaaaacctaa

SEQ ID NO: 123723 - DNA, 25 bp, Homo sapien
actcccccacaacagtgtaaaagct

SEQ ID NO: 123724 - DNA, 25 bp, Homo sapien
actcccccccaacagtgtaaaagct

SEQ ID NO: 123725 - DNA, 25 bp, Homo sapien
actgttggtggtactgtgaattagt

SEQ ID NO: 123726 - DNA, 25 bp, Homo sapien
actgttggtggtagtgtgaattagt

SEQ ID NO: 123727 - DNA, 25 bp, Homo sapien
agaatgccaaatggtctctcttcaa

SEQ ID NO: 123728 - DNA, 25 bp, Homo sapien
agaatgccaaattgtctctcttcaa

SEQ ID NO: 123729 - DNA, 25 bp, Homo sapien
agcacttcaacggttcttttttttt

SEQ ID NO: 123730 - DNA, 25 bp, Homo sapien
agcacttcagcggttcttttttttt

SEQ ID NO: 123731 - DNA, 25 bp, Homo sapien
agcatcacatgcatattgcttttgt

SEQ ID NO: 123732 - DNA, 25 bp, Homo sapien
agcatcacgtgcatattgcttttgt

SEQ ID NO: 123733 - DNA, 25 bp, Homo sapien
agccaggcgttgcggcgcacatctg

SEQ ID NO: 123734 - DNA, 25 bp, Homo sapien
agccaggcgttgtggcgcacatctg

SEQ ID NO: 123735 - DNA, 25 bp, Homo sapien
agccatctctagaatgccaaattgt

SEQ ID NO: 123736 - DNA, 25 bp, Homo sapien
agccatctttagaatgccaaattgt

SEQ ID NO: 123737 - DNA, 25 bp, Homo sapien
agctacaagaaatgtgggaccacga

SEQ ID NO: 123738 - DNA, 25 bp, Homo sapien
agctacaagaaatgtgtgaccacga

SEQ ID NO: 123739 - DNA, 25 bp, Homo sapien
aggactccctattaaataaatggtg

SEQ ID NO: 123740 - DNA, 25 bp, Homo sapien
aggactccctattcaataaatggtg

SEQ ID NO: 123741 - DNA, 25 bp, Homo sapien
aggaggcggaggttgcagtgagcag

SEQ ID NO: 123742 - DNA, 25 bp, Homo sapien
aggaggcggaggttgcggtgagcag

SEQ ID NO: 123743 - DNA, 25 bp, Homo sapien
aggcgttgtggcgcacatctgtgat

SEQ ID NO: 123744 - DNA, 25 bp, Homo sapien
aggcgttgtggcgcacgtctgtgat

SEQ ID NO: 123745 - DNA, 25 bp, Homo sapien
agtatttgttcactttatttgaatg

SEQ ID NO: 123746 - DNA, 25 bp, Homo sapien
agtatttgttcattttatttgaatg

SEQ ID NO: 123747 - DNA, 25 bp, Homo sapien
agttgagaaaataaactggtagttg

SEQ ID NO: 123748 - DNA, 25 bp, Homo sapien
agttgagaaaataagctggtagttg

SEQ ID NO: 123749 - DNA, 25 bp, Homo sapien
ataaactggtagttgctttttcctt

SEQ ID NO: 123750 - DNA, 25 bp, Homo sapien
ataaactggtagtttctttttcctt

SEQ ID NO: 123751 - DNA, 25 bp, Homo sapien
ataaataggaatatgtgaatgatac

SEQ ID NO: 123752 - DNA, 25 bp, Homo sapien
ataaataggaatgtgtgaatgatac

SEQ ID NO: 123753 - DNA, 25 bp, Homo sapien
ataggaatatgtgaatgatacacag

SEQ ID NO: 123754 - DNA, 25 bp, Homo sapien
ataggaatgtgtgaatgatacacag

SEQ ID NO: 123755 - DNA, 25 bp, Homo sapien
atattgatgaaacacagttgggtgg

SEQ ID NO: 123756 - DNA, 25 bp, Homo sapien
atattgatgaaatacagttgggtgg

SEQ ID NO: 123757 - DNA, 25 bp, Homo sapien
atattttgctgagaatttttgcatt

SEQ ID NO: 123758 - DNA, 25 bp, Homo sapien
atattttgttgagaatttttgcatt

SEQ ID NO: 123759 - DNA, 25 bp, Homo sapien
atccgcagtagtggcaacatccacc

SEQ ID NO: 123760 - DNA, 25 bp, Homo sapien
atccgcagtagttgcaacatccacc

SEQ ID NO: 123761 - DNA, 25 bp, Homo sapien
atgaagcagaaactaaaaaaaaata

SEQ ID NO: 123762 - DNA, 25 bp, Homo sapien
atgaagcagaaactgaaaaaaaata

SEQ ID NO: 123763 - DNA, 25 bp, Homo sapien
atgccaaatggtctctcttcaactg

SEQ ID NO: 123764 - DNA, 25 bp, Homo sapien
atgccaaattgtctctcttcaactg

SEQ ID NO: 123765 - DNA, 25 bp, Homo sapien
atgtagccatctctagaatgccaaa

SEQ ID NO: 123766 - DNA, 25 bp, Homo sapien
atgtagccatctttagaatgccaaa

SEQ ID NO: 123767 - DNA, 25 bp, Homo sapien
atgtgggaccacgaggacatcataa

SEQ ID NO: 123768 - DNA, 25 bp, Homo sapien
atgtgggaccatgaggacatcataa

SEQ ID NO: 123769 - DNA, 25 bp, Homo sapien
atgtttgcatgtaaccatctttaga

SEQ ID NO: 123770 - DNA, 25 bp, Homo sapien
atgtttgcatgtagccatctttaga

SEQ ID NO: 123771 - DNA, 25 bp, Homo sapien
attctgtttcttataggtatatgac

SEQ ID NO: 123772 - DNA, 25 bp, Homo sapien
attctgtttcttatagttatatgac

SEQ ID NO: 123773 - DNA, 25 bp, Homo sapien
atttgttcactttatttgaatgtta

SEQ ID NO: 123774 - DNA, 25 bp, Homo sapien
atttgttcattttatttgaatgtta

SEQ ID NO: 123775 - DNA, 25 bp, Homo sapien
attttctgatgatccttaggtaagg

SEQ ID NO: 123776 - DNA, 25 bp, Homo sapien
attttctgatgattcttaggtaagg

SEQ ID NO: 123777 - DNA, 25 bp, Homo sapien
caagaaatgtgggaccacgaggaca

SEQ ID NO: 123778 - DNA, 25 bp, Homo sapien
caagaaatgtgtgaccacgaggaca

SEQ ID NO: 123779 - DNA, 25 bp, Homo sapien
cacgccagtggtgaaaacctaaatg

SEQ ID NO: 123780 - DNA, 25 bp, Homo sapien
cacgccagttgtgaaaacctaaatg

SEQ ID NO: 123781 - DNA, 25 bp, Homo sapien
caggcgttgcggcgcacatctgtga

SEQ ID NO: 123782 - DNA, 25 bp, Homo sapien
caggcgttgtggcgcacatctgtga

SEQ ID NO: 123783 - DNA, 25 bp, Homo sapien
catgatccatgtttccacagtaaga

SEQ ID NO: 123784 - DNA, 25 bp, Homo sapien
catgatccctgtttccacagtaaga

SEQ ID NO: 123785 - DNA, 25 bp, Homo sapien
catgtagccatctctagaatgccaa

SEQ ID NO: 123786 - DNA, 25 bp, Homo sapien
catgtagccatctttagaatgccaa

SEQ ID NO: 123787 - DNA, 25 bp, Homo sapien
catgtgagtagagtgacaaaacaga

SEQ ID NO: 123788 - DNA, 25 bp, Homo sapien
catgtgagtagagtgataaaacaga

SEQ ID NO: 123789 - DNA, 25 bp, Homo sapien
cattcatgagtaaaataataaaact

SEQ ID NO: 123790 - DNA, 25 bp, Homo sapien
cattcatgagtagaataataaaact

SEQ ID NO: 123791 - DNA, 25 bp, Homo sapien
ccatccgcagtagtggcaacatcca

SEQ ID NO: 123792 - DNA, 25 bp, Homo sapien
ccatccgcagtagttgcaacatcca

SEQ ID NO: 123793 - DNA, 25 bp, Homo sapien
ccatctctactaaaaacacacacac

SEQ ID NO: 123794 - DNA, 25 bp, Homo sapien
ccatctctgctaaaaacacacacac

SEQ ID NO: 123795 - DNA, 25 bp, Homo sapien
cctgaagcatcacatgcatattgct

SEQ ID NO: 123796 - DNA, 25 bp, Homo sapien
cctgaagcatcacgtgcatattgct

SEQ ID NO: 123797 - DNA, 25 bp, Homo sapien
ccttgtgaatatcccgctaggatcc

SEQ ID NO: 123798 - DNA, 25 bp, Homo sapien
ccttgtgaatatgccgctaggatcc

SEQ ID NO: 123799 - DNA, 25 bp, Homo sapien
cgcacgccagtggtgaaaacctaaa

SEQ ID NO: 123800 - DNA, 25 bp, Homo sapien
cgcacgccagttgtgaaaacctaaa

SEQ ID NO: 123801 - DNA, 25 bp, Homo sapien
cgcagtagtggcaacatccaccccc

SEQ ID NO: 123802 - DNA, 25 bp, Homo sapien
cgcagtagttgcaacatccaccccc

SEQ ID NO: 123803 - DNA, 25 bp, Homo sapien
cgggcttggtggcatacgcctgtaa

SEQ ID NO: 123804 - DNA, 25 bp, Homo sapien
cgggcttggtggcatatgcctgtaa

SEQ ID NO: 123805 - DNA, 25 bp, Homo sapien
ctaaagcacttcaacggttcttttt

SEQ ID NO: 123806 - DNA, 25 bp, Homo sapien
ctaaagcacttcagcggttcttttt

SEQ ID NO: 123807 - DNA, 25 bp, Homo sapien
ctacatgatccatgtttccacagta

SEQ ID NO: 123808 - DNA, 25 bp, Homo sapien
ctacatgatccctgtttccacagta

SEQ ID NO: 123809 - DNA, 25 bp, Homo sapien
ctccctattaaataaatggtgctga

SEQ ID NO: 123810 - DNA, 25 bp, Homo sapien
ctccctattcaataaatggtgctga

SEQ ID NO: 123811 - DNA, 25 bp, Homo sapien
ctccttgtgaatatcccgctaggat

SEQ ID NO: 123812 - DNA, 25 bp, Homo sapien
ctccttgtgaatatgccgctaggat

SEQ ID NO: 123813 - DNA, 25 bp, Homo sapien
ctgaagcatcacatgcatattgctt

SEQ ID NO: 123814 - DNA, 25 bp, Homo sapien
ctgaagcatcacgtgcatattgctt

SEQ ID NO: 123815 - DNA, 25 bp, Homo sapien
ctgatgatccttaggtaaggatttg

SEQ ID NO: 123816 - DNA, 25 bp, Homo sapien
ctgatgattcttaggtaaggatttg

SEQ ID NO: 123817 - DNA, 25 bp, Homo sapien
ctggatggggcctgaagcatcacgt

SEQ ID NO: 123818 - DNA, 25 bp, Homo sapien
ctggatggggcctggagcatcacgt

SEQ ID NO: 123819 - DNA, 25 bp, Homo sapien
ctggtagttgctttttccttaacag

SEQ ID NO: 123820 - DNA, 25 bp, Homo sapien
ctggtagtttctttttccttaacag

SEQ ID NO: 123821 - DNA, 25 bp, Homo sapien
ctgttggtggtactgtgaattagtt

SEQ ID NO: 123822 - DNA, 25 bp, Homo sapien
ctgttggtggtagtgtgaattagtt

SEQ ID NO: 123823 - DNA, 25 bp, Homo sapien
cttggtggcatacgcctgtaatccc

SEQ ID NO: 123824 - DNA, 25 bp, Homo sapien
cttggtggcatatgcctgtaatccc

SEQ ID NO: 123825 - DNA, 25 bp, Homo sapien
cttgtgaatatgccactaggatccc

SEQ ID NO: 123826 - DNA, 25 bp, Homo sapien
cttgtgaatatgccgctaggatccc

SEQ ID NO: 123827 - DNA, 25 bp, Homo sapien
ctttagaatgccaaatggtctctct

SEQ ID NO: 123828 - DNA, 25 bp, Homo sapien
ctttagaatgccaaattgtctctct

SEQ ID NO: 123829 - DNA, 25 bp, Homo sapien
ctttatattgatgaaacacagttgg

SEQ ID NO: 123830 - DNA, 25 bp, Homo sapien
ctttatattgatgaaatacagttgg

SEQ ID NO: 123831 - DNA, 25 bp, Homo sapien
ctttgtcttacctgattgctctgga

SEQ ID NO: 123832 - DNA, 25 bp, Homo sapien
ctttgtcttgcctgattgctctgga

SEQ ID NO: 123833 - DNA, 25 bp, Homo sapien
gaaaataaactggtagttgcttttt

SEQ ID NO: 123834 - DNA, 25 bp, Homo sapien
gaaaataagctggtagttgcttttt

SEQ ID NO: 123835 - DNA, 25 bp, Homo sapien
gaaaccccatctctactaaaaacac

SEQ ID NO: 123836 - DNA, 25 bp, Homo sapien
gaaaccccatctctgctaaaaacac

SEQ ID NO: 123837 - DNA, 25 bp, Homo sapien
gaaatgtgggaccacgaggacatca

SEQ ID NO: 123838 - DNA, 25 bp, Homo sapien
gaaatgtgggaccatgaggacatca

SEQ ID NO: 123839 - DNA, 25 bp, Homo sapien
gaaatgtgtgaccacgaggacatca

SEQ ID NO: 123840 - DNA, 25 bp, Homo sapien
gaagcagaaactaaaaaaaaataga

SEQ ID NO: 123841 - DNA, 25 bp, Homo sapien
gaagcagaaactgaaaaaaaataga

SEQ ID NO: 123842 - DNA, 25 bp, Homo sapien
gaattttttgagctaattagctact

SEQ ID NO: 123843 - DNA, 25 bp, Homo sapien
gaatttttttagctaattagctact

SEQ ID NO: 123844 - DNA, 25 bp, Homo sapien
gacattcatgagtaaaataataaaa

SEQ ID NO: 123845 - DNA, 25 bp, Homo sapien
gacattcatgagtagaataataaaa

SEQ ID NO: 123846 - DNA, 25 bp, Homo sapien
gactccctattaaataaatggtgct

SEQ ID NO: 123847 - DNA, 25 bp, Homo sapien
gactccctattcaataaatggtgct

SEQ ID NO: 123848 - DNA, 25 bp, Homo sapien
gagaggactccctattaaataaatg

SEQ ID NO: 123849 - DNA, 25 bp, Homo sapien
gagaggactccctattcaataaatg

SEQ ID NO: 123850 - DNA, 25 bp, Homo sapien
gaggcggaggttgcagtgagcagag

SEQ ID NO: 123851 - DNA, 25 bp, Homo sapien
gaggcggaggttgcggtgagcagag

SEQ ID NO: 123852 - DNA, 25 bp, Homo sapien
gatggggcctgaagcatcacgtgca

SEQ ID NO: 123853 - DNA, 25 bp, Homo sapien
gatggggcctggagcatcacgtgca

SEQ ID NO: 123854 - DNA, 25 bp, Homo sapien
gcacttcaacggttctttttttttt

SEQ ID NO: 123855 - DNA, 25 bp, Homo sapien
gcacttcagcggttctttttttttt

SEQ ID NO: 123856 - DNA, 25 bp, Homo sapien
gcagaaactaaaaaaaaatagatgg

SEQ ID NO: 123857 - DNA, 25 bp, Homo sapien
gcagaaactgaaaaaaaatagatgg

SEQ ID NO: 123858 - DNA, 25 bp, Homo sapien
gcagtagtggcaacatccacccccg

SEQ ID NO: 123859 - DNA, 25 bp, Homo sapien
gcagtagttgcaacatccacccccg

SEQ ID NO: 123860 - DNA, 25 bp, Homo sapien
gcctgaagcatcacatgcatattgc

SEQ ID NO: 123861 - DNA, 25 bp, Homo sapien
gcctgaagcatcacgtgcatattgc

SEQ ID NO: 123862 - DNA, 25 bp, Homo sapien
gcggaggttgcagtgagcagagatc

SEQ ID NO: 123863 - DNA, 25 bp, Homo sapien
gcggaggttgcggtgagcagagatc

SEQ ID NO: 123864 - DNA, 25 bp, Homo sapien
gcgttgtggcgcacatctgtgatcc

SEQ ID NO: 123865 - DNA, 25 bp, Homo sapien
gcgttgtggcgcacgtctgtgatcc

SEQ ID NO: 123866 - DNA, 25 bp, Homo sapien
gcttggtggcatacgcctgtaatcc

SEQ ID NO: 123867 - DNA, 25 bp, Homo sapien
gcttggtggcatatgcctgtaatcc

SEQ ID NO: 123868 - DNA, 25 bp, Homo sapien
ggactccctattaaataaatggtgc

SEQ ID NO: 123869 - DNA, 25 bp, Homo sapien
ggactccctattcaataaatggtgc

SEQ ID NO: 123870 - DNA, 25 bp, Homo sapien
ggaggttgcagtgagcagagatcat

SEQ ID NO: 123871 - DNA, 25 bp, Homo sapien
ggaggttgcggtgagcagagatcat

SEQ ID NO: 123872 - DNA, 25 bp, Homo sapien
ggatggggcctgaagcatcacgtgc

SEQ ID NO: 123873 - DNA, 25 bp, Homo sapien
ggatggggcctggagcatcacgtgc

SEQ ID NO: 123874 - DNA, 25 bp, Homo sapien
ggcggaggttgcagtgagcagagat

SEQ ID NO: 123875 - DNA, 25 bp, Homo sapien
ggcggaggttgcggtgagcagagat

SEQ ID NO: 123876 - DNA, 25 bp, Homo sapien
ggcttggtggcatacgcctgtaatc

SEQ ID NO: 123877 - DNA, 25 bp, Homo sapien
ggcttggtggcatatgcctgtaatc

SEQ ID NO: 123878 - DNA, 25 bp, Homo sapien
ggggcctgaagcatcacgtgcatat

SEQ ID NO: 123879 - DNA, 25 bp, Homo sapien
ggggcctggagcatcacgtgcatat

SEQ ID NO: 123880 - DNA, 25 bp, Homo sapien
ggtagaattttttgagctaattagc

SEQ ID NO: 123881 - DNA, 25 bp, Homo sapien
ggtagaatttttttagctaattagc

SEQ ID NO: 123882 - DNA, 25 bp, Homo sapien
gtagaattttttgagctaattagct

SEQ ID NO: 123883 - DNA, 25 bp, Homo sapien
gtagaatttttttagctaattagct

SEQ ID NO: 123884 - DNA, 25 bp, Homo sapien
gtagagtgacaaaacagaattcttt

SEQ ID NO: 123885 - DNA, 25 bp, Homo sapien
gtagagtgataaaacagaattcttt

SEQ ID NO: 123886 - DNA, 25 bp, Homo sapien
gtatttgttcactttatttgaatgt

SEQ ID NO: 123887 - DNA, 25 bp, Homo sapien
gtatttgttcattttatttgaatgt

SEQ ID NO: 123888 - DNA, 25 bp, Homo sapien
gtcaatattttgctgagaatttttg

SEQ ID NO: 123889 - DNA, 25 bp, Homo sapien
gtcaatattttgttgagaatttttg

SEQ ID NO: 123890 - DNA, 25 bp, Homo sapien
gtcttcaaaataagggcttgtttct

SEQ ID NO: 123891 - DNA, 25 bp, Homo sapien
gtcttcaaaatatgggcttgtttct

SEQ ID NO: 123892 - DNA, 25 bp, Homo sapien
gtgaaaccccatctctactaaaaac

SEQ ID NO: 123893 - DNA, 25 bp, Homo sapien
gtgaaaccccatctctgctaaaaac

SEQ ID NO: 123894 - DNA, 25 bp, Homo sapien
gtgaatatcccgctaggatcccaaa

SEQ ID NO: 123895 - DNA, 25 bp, Homo sapien
gtgaatatgccgctaggatcccaaa

SEQ ID NO: 123896 - DNA, 25 bp, Homo sapien
gtgagtagagtgacaaaacagaatt

SEQ ID NO: 123897 - DNA, 25 bp, Homo sapien
gtgagtagagtgataaaacagaatt

SEQ ID NO: 123898 - DNA, 25 bp, Homo sapien
gtggcatacgcctgtaatcccagct

SEQ ID NO: 123899 - DNA, 25 bp, Homo sapien
gtggcatatgcctgtaatcccagct

SEQ ID NO: 123900 - DNA, 25 bp, Homo sapien
gtggcgcacatctgtgatcccagct

SEQ ID NO: 123901 - DNA, 25 bp, Homo sapien
gtggcgcacgtctgtgatcccagct

SEQ ID NO: 123902 - DNA, 25 bp, Homo sapien
gtgggaccacgaggacatcataacc

SEQ ID NO: 123903 - DNA, 25 bp, Homo sapien
gtgggaccatgaggacatcataacc

SEQ ID NO: 123904 - DNA, 25 bp, Homo sapien
gttgagaaaataaactggtagttgc

SEQ ID NO: 123905 - DNA, 25 bp, Homo sapien
gttgagaaaataagctggtagttgc

SEQ ID NO: 123906 - DNA, 25 bp, Homo sapien
gttgtggcgcacatctgtgatccca

SEQ ID NO: 123907 - DNA, 25 bp, Homo sapien
gttgtggcgcacgtctgtgatccca

SEQ ID NO: 123908 - DNA, 25 bp, Homo sapien
gtttcttataggtatatgactgaga

SEQ ID NO: 123909 - DNA, 25 bp, Homo sapien
gtttcttatagttatatgactgaga

SEQ ID NO: 123910 - DNA, 25 bp, Homo sapien
gtttgcatgtaaccatctttagaat

SEQ ID NO: 123911 - DNA, 25 bp, Homo sapien
gtttgcatgtagccatctttagaat

SEQ ID NO: 123912 - DNA, 25 bp, Homo sapien
taaactggtagttgctttttcctta

SEQ ID NO: 123913 - DNA, 25 bp, Homo sapien
taaactggtagtttctttttcctta

SEQ ID NO: 123914 - DNA, 25 bp, Homo sapien
taaagcacttcaacggttctttttt

SEQ ID NO: 123915 - DNA, 25 bp, Homo sapien
taaagcacttcagcggttctttttt

SEQ ID NO: 123916 - DNA, 25 bp, Homo sapien
taaataggaatatgtgaatgataca

SEQ ID NO: 123917 - DNA, 25 bp, Homo sapien
taaataggaatgtgtgaatgataca

SEQ ID NO: 123918 - DNA, 25 bp, Homo sapien
taaatctacatgatccatgtttcca

SEQ ID NO: 123919 - DNA, 25 bp, Homo sapien
taaatctacatgatccctgtttcca

SEQ ID NO: 123920 - DNA, 25 bp, Homo sapien
taaggtagaattttttgagctaatt

SEQ ID NO: 123921 - DNA, 25 bp, Homo sapien
taaggtagaatttttttagctaatt

SEQ ID NO: 123922 - DNA, 25 bp, Homo sapien
taatttacactcccccacaacagtg

SEQ ID NO: 123923 - DNA, 25 bp, Homo sapien
taatttacactcccccccaacagtg

SEQ ID NO: 123924 - DNA, 25 bp, Homo sapien
tacaagaaatgtgggaccacgagga

SEQ ID NO: 123925 - DNA, 25 bp, Homo sapien
tacaagaaatgtgtgaccacgagga

SEQ ID NO: 123926 - DNA, 25 bp, Homo sapien
tacactcccccacaacagtgtaaaa

SEQ ID NO: 123927 - DNA, 25 bp, Homo sapien
tacactcccccccaacagtgtaaaa

SEQ ID NO: 123928 - DNA, 25 bp, Homo sapien
tacactgttggtggtactgtgaatt

SEQ ID NO: 123929 - DNA, 25 bp, Homo sapien
tacactgttggtggtagtgtgaatt

SEQ ID NO: 123930 - DNA, 25 bp, Homo sapien
tagaattttttgagctaattagcta

SEQ ID NO: 123931 - DNA, 25 bp, Homo sapien
tagaatttttttagctaattagcta

SEQ ID NO: 123932 - DNA, 25 bp, Homo sapien
tagccaggcgttgcggcgcacatct

SEQ ID NO: 123933 - DNA, 25 bp, Homo sapien
tagccaggcgttgtggcgcacatct

SEQ ID NO: 123934 - DNA, 25 bp, Homo sapien
tagtcttcaaaataagggcttgttt

SEQ ID NO: 123935 - DNA, 25 bp, Homo sapien
tagtcttcaaaatatgggcttgttt

SEQ ID NO: 123936 - DNA, 25 bp, Homo sapien
tatattgatgaaacacagttgggtg

SEQ ID NO: 123937 - DNA, 25 bp, Homo sapien
tatattgatgaaatacagttgggtg

SEQ ID NO: 123938 - DNA, 25 bp, Homo sapien
tatattttctgatgatccttaggta

SEQ ID NO: 123939 - DNA, 25 bp, Homo sapien
tatattttctgatgattcttaggta

SEQ ID NO: 123940 - DNA, 25 bp, Homo sapien
tattgatgaaacacagttgggtggt

SEQ ID NO: 123941 - DNA, 25 bp, Homo sapien
tattgatgaaatacagttgggtggt

SEQ ID NO: 123942 - DNA, 25 bp, Homo sapien
tcaatattttgctgagaatttttgc

SEQ ID NO: 123943 - DNA, 25 bp, Homo sapien
tcaatattttgttgagaatttttgc

SEQ ID NO: 123944 - DNA, 25 bp, Homo sapien
tcatgagtaaaataataaaactgac

SEQ ID NO: 123945 - DNA, 25 bp, Homo sapien
tcatgagtagaataataaaactgac

SEQ ID NO: 123946 - DNA, 25 bp, Homo sapien
tccgcagtagtggcaacatccaccc

SEQ ID NO: 123947 - DNA, 25 bp, Homo sapien
tccgcagtagttgcaacatccaccc

SEQ ID NO: 123948 - DNA, 25 bp, Homo sapien
tccttgtgaatatcccgctaggatc

SEQ ID NO: 123949 - DNA, 25 bp, Homo sapien
tccttgtgaatatgccactaggatc

SEQ ID NO: 123950 - DNA, 25 bp, Homo sapien
tccttgtgaatatgccgctaggatc

SEQ ID NO: 123951 - DNA, 25 bp, Homo sapien
tctacatgatccatgtttccacagt

SEQ ID NO: 123952 - DNA, 25 bp, Homo sapien
tctacatgatccctgtttccacagt

SEQ ID NO: 123953 - DNA, 25 bp, Homo sapien
tcttataggtatatgactgagatcc

SEQ ID NO: 123954 - DNA, 25 bp, Homo sapien
tcttatagttatatgactgagatcc

SEQ ID NO: 123955 - DNA, 25 bp, Homo sapien
tcttcaaaataagggcttgtttctg

SEQ ID NO: 123956 - DNA, 25 bp, Homo sapien
tcttcaaaatatgggcttgtttctg

SEQ ID NO: 123957 - DNA, 25 bp, Homo sapien
tgaagcagaaactaaaaaaaaatag

SEQ ID NO: 123958 - DNA, 25 bp, Homo sapien
tgaagcagaaactgaaaaaaaatag

SEQ ID NO: 123959 - DNA, 25 bp, Homo sapien
tgaagcatcacatgcatattgcttt

SEQ ID NO: 123960 - DNA, 25 bp, Homo sapien
tgaagcatcacgtgcatattgcttt

SEQ ID NO: 123961 - DNA, 25 bp, Homo sapien
tgagaaaataaactggtagttgctt

SEQ ID NO: 123962 - DNA, 25 bp, Homo sapien
tgagaaaataagctggtagttgctt

SEQ ID NO: 123963 - DNA, 25 bp, Homo sapien
tgagtagagtgacaaaacagaattc

SEQ ID NO: 123964 - DNA, 25 bp, Homo sapien
tgagtagagtgataaaacagaattc

SEQ ID NO: 123965 - DNA, 25 bp, Homo sapien
tgcatgtaaccatctttagaatgcc

SEQ ID NO: 123966 - DNA, 25 bp, Homo sapien
tgcatgtagccatctttagaatgcc

SEQ ID NO: 123967 - DNA, 25 bp, Homo sapien
tgccaaatggtctctcttcaactgg

SEQ ID NO: 123968 - DNA, 25 bp, Homo sapien
tgccaaattgtctctcttcaactgg

SEQ ID NO: 123969 - DNA, 25 bp, Homo sapien
tggacattcatgagtaaaataataa

SEQ ID NO: 123970 - DNA, 25 bp, Homo sapien
tggacattcatgagtagaataataa

SEQ ID NO: 123971 - DNA, 25 bp, Homo sapien
tggcgcacatctgtgatcccagcta

SEQ ID NO: 123972 - DNA, 25 bp, Homo sapien
tggcgcacgtctgtgatcccagcta

SEQ ID NO: 123973 - DNA, 25 bp, Homo sapien
tggctaaagcacttcaacggttctt

SEQ ID NO: 123974 - DNA, 25 bp, Homo sapien
tggctaaagcacttcagcggttctt

SEQ ID NO: 123975 - DNA, 25 bp, Homo sapien
tggggcctgaagcatcacgtgcata

SEQ ID NO: 123976 - DNA, 25 bp, Homo sapien
tggggcctggagcatcacgtgcata

SEQ ID NO: 123977 - DNA, 25 bp, Homo sapien
tggtagttgctttttccttaacaga

SEQ ID NO: 123978 - DNA, 25 bp, Homo sapien
tggtagtttctttttccttaacaga

SEQ ID NO: 123979 - DNA, 25 bp, Homo sapien
tgtagccatctctagaatgccaaat

SEQ ID NO: 123980 - DNA, 25 bp, Homo sapien
tgtagccatctttagaatgccaaat

SEQ ID NO: 123981 - DNA, 25 bp, Homo sapien
tgtagtcttcaaaataagggcttgt

SEQ ID NO: 123982 - DNA, 25 bp, Homo sapien
tgtagtcttcaaaatatgggcttgt

SEQ ID NO: 123983 - DNA, 25 bp, Homo sapien
tgtcaatattttgctgagaattttt

SEQ ID NO: 123984 - DNA, 25 bp, Homo sapien
tgtcaatattttgttgagaattttt

SEQ ID NO: 123985 - DNA, 25 bp, Homo sapien
tgtgaatatcccgctaggatcccaa

SEQ ID NO: 123986 - DNA, 25 bp, Homo sapien
tgtgaatatgccactaggatcccaa

SEQ ID NO: 123987 - DNA, 25 bp, Homo sapien
tgtgaatatgccgctaggatcccaa

SEQ ID NO: 123988 - DNA, 25 bp, Homo sapien
tgtgagtagagtgacaaaacagaat

SEQ ID NO: 123989 - DNA, 25 bp, Homo sapien
tgtgagtagagtgataaaacagaat

SEQ ID NO: 123990 - DNA, 25 bp, Homo sapien
tgttggtggtactgtgaattagttc

SEQ ID NO: 123991 - DNA, 25 bp, Homo sapien
tgttggtggtagtgtgaattagttc

SEQ ID NO: 123992 - DNA, 25 bp, Homo sapien
tgtttcttataggtatatgactgag

SEQ ID NO: 123993 - DNA, 25 bp, Homo sapien
tgtttcttatagttatatgactgag

SEQ ID NO: 123994 - DNA, 25 bp, Homo sapien
tgtttctttgtcttacctgattgct

SEQ ID NO: 123995 - DNA, 25 bp, Homo sapien
tgtttctttgtcttgcctgattgct

SEQ ID NO: 123996 - DNA, 25 bp, Homo sapien
tgtttgcatgtaaccatctttagaa

SEQ ID NO: 123997 - DNA, 25 bp, Homo sapien
tgtttgcatgtagccatctttagaa

SEQ ID NO: 123998 - DNA, 25 bp, Homo sapien
ttacactcccccacaacagtgtaaa

SEQ ID NO: 123999 - DNA, 25 bp, Homo sapien
ttacactcccccccaacagtgtaaa

SEQ ID NO: 124000 - DNA, 25 bp, Homo sapien
ttagaatgccaaatggtctctcttc

SEQ ID NO: 124001 - DNA, 25 bp, Homo sapien
ttagaatgccaaattgtctctcttc

SEQ ID NO: 124002 - DNA, 25 bp, Homo sapien
ttagccaggcgttgcggcgcacatc

SEQ ID NO: 124003 - DNA, 25 bp, Homo sapien
ttagccaggcgttgtggcgcacatc

SEQ ID NO: 124004 - DNA, 25 bp, Homo sapien
ttatattgatgaaacacagttgggt

SEQ ID NO: 124005 - DNA, 25 bp, Homo sapien
ttatattgatgaaatacagttgggt

SEQ ID NO: 124006 - DNA, 25 bp, Homo sapien
ttcaaaataagggcttgtttctgtc

SEQ ID NO: 124007 - DNA, 25 bp, Homo sapien
ttcaaaatatgggcttgtttctgtc

SEQ ID NO: 124008 - DNA, 25 bp, Homo sapien
ttcttataggtatatgactgagatc

SEQ ID NO: 124009 - DNA, 25 bp, Homo sapien
ttcttatagttatatgactgagatc

SEQ ID NO: 124010 - DNA, 25 bp, Homo sapien
ttgagaaaataaactggtagttgct

SEQ ID NO: 124011 - DNA, 25 bp, Homo sapien
ttgagaaaataagctggtagttgct

SEQ ID NO: 124012 - DNA, 25 bp, Homo sapien
ttgcatgtagccatctctagaatgc

SEQ ID NO: 124013 - DNA, 25 bp, Homo sapien
ttgcatgtagccatctttagaatgc

SEQ ID NO: 124014 - DNA, 25 bp, Homo sapien
ttggtggtactgtgaattagttcaa

SEQ ID NO: 124015 - DNA, 25 bp, Homo sapien
ttggtggtagtgtgaattagttcaa

SEQ ID NO: 124016 - DNA, 25 bp, Homo sapien
ttgtgaatatgccactaggatccca

SEQ ID NO: 124017 - DNA, 25 bp, Homo sapien
ttgtgaatatgccgctaggatccca

SEQ ID NO: 124018 - DNA, 25 bp, Homo sapien
tttacactcccccacaacagtgtaa

SEQ ID NO: 124019 - DNA, 25 bp, Homo sapien
tttacactcccccccaacagtgtaa

SEQ ID NO: 124020 - DNA, 25 bp, Homo sapien
tttctgatgatccttaggtaaggat

SEQ ID NO: 124021 - DNA, 25 bp, Homo sapien
tttctgatgattcttaggtaaggat

SEQ ID NO: 124022 - DNA, 25 bp, Homo sapien
tttctttgtcttacctgattgctct

SEQ ID NO: 124023 - DNA, 25 bp, Homo sapien
tttctttgtcttgcctgattgctct

SEQ ID NO: 124024 - DNA, 25 bp, Homo sapien
tttgtcttacctgattgctctggat

SEQ ID NO: 124025 - DNA, 25 bp, Homo sapien
tttgtcttgcctgattgctctggat

SEQ ID NO: 124026 - DNA, 25 bp, Homo sapien
tttgttcactttatttgaatgttat

SEQ ID NO: 124027 - DNA, 25 bp, Homo sapien
tttgttcattttatttgaatgttat

SEQ ID NO: 124028 - DNA, 25 bp, Homo sapien
tttgtttctttgtcttacctgattg

SEQ ID NO: 124029 - DNA, 25 bp, Homo sapien
tttgtttctttgtcttgcctgattg

SEQ ID NO: 124030 - DNA, 25 bp, Homo sapien
ttttctgatgatccttaggtaagga

SEQ ID NO: 124031 - DNA, 25 bp, Homo sapien
ttttctgatgattcttaggtaagga
